US009340786B2

(12) United States Patent
Khvorova et al.

(10) Patent No.: US 9,340,786 B2
(45) Date of Patent: May 17, 2016

(54) RNA INTERFERENCE IN DERMAL AND FIBROTIC INDICATIONS

(75) Inventors: Anastasia Khvorova, Westborough, MA (US); William Salomon, Worcester, MA (US); Joanne Kamens, Newton, MA (US); Dmitry Samarsky, Westborough, MA (US); Tod M. Woolf, Sudbury, MA (US); Pamela A. Pavco, Longmont, CO (US); Lyn Libertine, Framingham, MA (US); James Cardia, Franklin, MA (US); Karen G. Bulock, Mendon, MA (US)

(73) Assignee: RXi Pharmaceuticals Corporation, Marlborough, MA (US)

(*) Notice: Subject to any disclaimer, the term of this patent is extended or adjusted under 35 U.S.C. 154(b) by 0 days.

(21) Appl. No.: 13/636,755

(22) PCT Filed: Mar. 24, 2011

(86) PCT No.: PCT/US2011/029867
§ 371 (c)(1),
(2), (4) Date: Apr. 4, 2013

(87) PCT Pub. No.: WO2011/119887
PCT Pub. Date: Sep. 29, 2011

(65) Prior Publication Data
US 2014/0113950 A1    Apr. 24, 2014

Related U.S. Application Data

(60) Provisional application No. 61/317,633, filed on Mar. 25, 2010, provisional application No. 61/317,252, filed on Mar. 24, 2010.

(51) Int. Cl.
*A61K 48/00* (2006.01)
*C07H 21/02* (2006.01)
*C07H 21/04* (2006.01)
*C12N 15/113* (2010.01)

(52) U.S. Cl.
CPC .......... *C12N 15/1136* (2013.01); *C12N 15/113* (2013.01); *C12N 2310/14* (2013.01); *C12N 2310/315* (2013.01); *C12N 2310/3341* (2013.01); *C12N 2310/3515* (2013.01); *C12N 2320/32* (2013.01); *C12N 2320/52* (2013.01)

(58) Field of Classification Search
CPC .......................... C12N 15/113; C12N 2310/11
See application file for complete search history.

(56) References Cited

U.S. PATENT DOCUMENTS

| 3,687,808 A | 8/1972 | Merigan et al. |
|---|---|---|
| 4,201,860 A | 5/1980 | Naito et al. |
| 4,235,871 A | 11/1980 | Papahadjopoulos et al. |
| 4,415,732 A | 11/1983 | Caruthers et al. |
| 4,426,330 A | 1/1984 | Sears |
| 4,501,728 A | 2/1985 | Geho et al. |
| 4,737,323 A | 4/1988 | Martin et al. |
| 4,837,028 A | 6/1989 | Allen |
| 4,853,386 A | 8/1989 | Friebe et al. |
| 4,897,355 A | 1/1990 | Eppstein et al. |
| 4,904,582 A | 2/1990 | Tullis |
| 4,958,013 A | 9/1990 | Letsinger |
| 5,023,243 A | 6/1991 | Tullis |
| 5,112,963 A | 5/1992 | Pieles et al. |
| 5,151,510 A | 9/1992 | Stec et al. |
| 5,188,897 A | 2/1993 | Suhadolnik et al. |
| 5,264,423 A | 11/1993 | Cohen et al. |
| 5,264,562 A | 11/1993 | Matteucci |
| 5,405,939 A | 4/1995 | Suhadolnik |
| 5,414,077 A | 5/1995 | Lin et al. |
| 5,416,203 A | 5/1995 | Letsinger |
| 5,417,978 A | 5/1995 | Tari et al. |
| 5,419,966 A | 5/1995 | Reed et al. |
| 5,432,272 A | 7/1995 | Benner |
| 5,453,496 A | 9/1995 | Caruthers et al. |
| 5,459,255 A | 10/1995 | Cook et al. |
| 5,466,786 A | 11/1995 | Buhr et al. |
| 5,470,967 A | 11/1995 | Huie et al. |
| 5,486,603 A | 1/1996 | Buhr |
| 5,489,677 A | 2/1996 | Sanghvi et al. |
| 5,495,009 A | 2/1996 | Matteucci et al. |
| 5,512,667 A | 4/1996 | Reed et al. |
| 5,514,786 A | 5/1996 | Cook et al. |
| 5,532,130 A | 7/1996 | Alul |
| 5,534,259 A | 7/1996 | Zalipsky et al. |
| 5,556,948 A | 9/1996 | Tagawa et al. |
| 5,561,225 A | 10/1996 | Maddry et al. |

(Continued)

FOREIGN PATENT DOCUMENTS

| AU | 2004206255 B2 | 8/2004 |
|---|---|---|
| CN | 1 568 373 A | 1/2005 |
| EP | 0 552 766 A2 | 7/1993 |
| EP | 1 214 945 A2 | 6/2002 |
| EP | 1 144 623 B9 | 3/2003 |
| EP | 1 352 061 B1 | 10/2003 |
| EP | 0 928 290 B9 | 3/2005 |
| EP | 1 407 044 B1 | 9/2007 |

(Continued)

OTHER PUBLICATIONS

[No Author Listed] RedChip Small-Cap Investor Conference. RXI Pharmaceuticals (Nasdaq RXII). Jun. 16, 2009 Presentation. 5 pages.

(Continued)

*Primary Examiner* — Amy Bowman
(74) *Attorney, Agent, or Firm* — Wolf, Greenfield & Sacks, P.C.

(57) ABSTRACT

The present invention relates to RNAi constructs with improved tissue and cellular uptake characteristics and methods of use of these compounds in dermal and fibrotic applications.

20 Claims, 64 Drawing Sheets

(56) References Cited

U.S. PATENT DOCUMENTS

| | | |
|---|---|---|
| 5,578,718 A | 11/1996 | Cook et al. |
| 5,580,731 A | 12/1996 | Chang et al. |
| 5,580,972 A | 12/1996 | Tu et al. |
| 5,587,469 A | 12/1996 | Cook et al. |
| 5,591,721 A | 1/1997 | Agrawal et al. |
| 5,591,722 A | 1/1997 | Montgomery et al. |
| 5,591,843 A | 1/1997 | Eaton |
| 5,594,121 A | 1/1997 | Froehler et al. |
| 5,596,086 A | 1/1997 | Matteucci et al. |
| 5,596,091 A | 1/1997 | Switzer |
| 5,599,797 A | 2/1997 | Cook et al. |
| 5,602,240 A | 2/1997 | De Mesmaeker et al. |
| 5,607,923 A | 3/1997 | Cook et al. |
| 5,614,617 A | 3/1997 | Cook et al. |
| 5,614,621 A | 3/1997 | Ravikumar et al. |
| 5,623,070 A | 4/1997 | Cook et al. |
| 5,625,050 A | 4/1997 | Beaton et al. |
| 5,633,360 A | 5/1997 | Bischofberger et al. |
| 5,643,889 A | 7/1997 | Suhadolnik et al. |
| 5,646,126 A | 7/1997 | Cheng et al. |
| 5,646,265 A | 7/1997 | McGee |
| 5,652,359 A | 7/1997 | Meyer, Jr. et al. |
| 5,658,731 A | 8/1997 | Sproat et al. |
| 5,661,134 A | 8/1997 | Cook et al. |
| 5,663,312 A | 9/1997 | Chaturvedula |
| 5,670,633 A | 9/1997 | Cook et al. |
| 5,681,940 A | 10/1997 | Wang et al. |
| 5,681,941 A | 10/1997 | Cook et al. |
| 5,684,143 A | 11/1997 | Gryaznov et al. |
| 5,700,920 A | 12/1997 | Altmann et al. |
| 5,736,392 A | 4/1998 | Hawley-Nelson et al. |
| 5,750,666 A | 5/1998 | Caruthers et al. |
| 5,767,099 A | 6/1998 | Harris et al. |
| 5,770,209 A | 6/1998 | Grotendorst et al. |
| 5,770,713 A | 6/1998 | Imbach et al. |
| 5,777,153 A | 7/1998 | Lin et al. |
| 5,780,053 A | 7/1998 | Ashley et al. |
| 5,789,416 A | 8/1998 | Lum et al. |
| 5,792,847 A | 8/1998 | Buhr et al. |
| 5,808,023 A | 9/1998 | Sanghvi et al. |
| 5,817,781 A | 10/1998 | Swaminathan et al. |
| 5,830,430 A | 11/1998 | Unger et al. |
| 5,830,653 A | 11/1998 | Froehler et al. |
| 5,851,548 A | 12/1998 | Dattagupta et al. |
| 5,855,910 A | 1/1999 | Ashley et al. |
| 5,856,455 A | 1/1999 | Cook |
| 5,914,396 A | 6/1999 | Cook et al. |
| 5,945,521 A | 8/1999 | Just et al. |
| 5,948,767 A | 9/1999 | Scheule et al. |
| 5,969,116 A | 10/1999 | Martin |
| 5,976,567 A | 11/1999 | Wheeler et al. |
| 5,981,501 A | 11/1999 | Wheeler et al. |
| 5,986,083 A | 11/1999 | Dwyer et al. |
| 6,001,841 A | 12/1999 | Cook et al. |
| 6,005,096 A | 12/1999 | Matteucci et al. |
| 6,015,886 A | 1/2000 | Dale et al. |
| 6,020,475 A | 2/2000 | Capaldi et al. |
| 6,020,483 A | 2/2000 | Beckvermit et al. |
| 6,028,183 A | 2/2000 | Lin et al. |
| 6,043,352 A | 3/2000 | Manoharan et al. |
| 6,051,699 A | 4/2000 | Ravikumar |
| 6,107,094 A | 8/2000 | Crooke |
| 6,111,085 A | 8/2000 | Cook et al. |
| 6,121,437 A | 9/2000 | Guzaev |
| 6,153,737 A | 11/2000 | Manoharan et al. |
| 6,207,819 B1 | 3/2001 | Manoharan et al. |
| 6,221,911 B1 | 4/2001 | Lavin et al. |
| 6,232,064 B1 | 5/2001 | Grotendorst et al. |
| 6,271,358 B1 | 8/2001 | Manoharan et al. |
| 6,326,358 B1 | 12/2001 | Manoharan |
| 6,331,617 B1 | 12/2001 | Weeks et al. |
| 6,333,152 B1 | 12/2001 | Vogelstein et al. |
| 6,335,434 B1 | 1/2002 | Guzaev et al. |
| 6,355,787 B1 | 3/2002 | Beckvermit et al. |
| 6,358,931 B1 | 3/2002 | Cook et al. |
| 6,395,492 B1 | 5/2002 | Manoharan et al. |
| 6,399,754 B1 | 6/2002 | Cook |
| 6,410,702 B1 | 6/2002 | Swaminathan et al. |
| 6,420,549 B1 | 7/2002 | Cook et al. |
| 6,432,963 B1 | 8/2002 | Hisamichi et al. |
| 6,440,943 B1 | 8/2002 | Cook et al. |
| 6,444,806 B1 | 9/2002 | Veerapanani et al. |
| 6,465,628 B1 | 10/2002 | Ravikumar et al. |
| 6,475,490 B1 | 11/2002 | Srivastava et al. |
| 6,476,205 B1 | 11/2002 | Buhr et al. |
| 6,492,129 B1 | 12/2002 | Grotendorst |
| 6,506,559 B1 | 1/2003 | Fire et al. |
| 6,528,631 B1 | 3/2003 | Cook et al. |
| 6,531,584 B1 | 3/2003 | Cook et al. |
| 6,534,639 B1 | 3/2003 | Manoharan et al. |
| 6,562,618 B1 | 5/2003 | Tamatani et al. |
| 6,673,611 B2 | 1/2004 | Thompson et al. |
| 6,683,167 B2 | 1/2004 | Metelev et al. |
| 6,706,491 B1 | 3/2004 | Chang et al. |
| 6,753,321 B2 | 6/2004 | Kovesdi |
| 6,815,432 B2 | 11/2004 | Wheeler et al. |
| 6,818,759 B2 | 11/2004 | Beigelman et al. |
| 6,849,726 B2 | 2/2005 | Usman et al. |
| 6,858,225 B2 | 2/2005 | Semple et al. |
| 6,923,833 B2 | 8/2005 | Wasielewski |
| 6,965,025 B2 | 11/2005 | Gaarde et al. |
| 7,041,824 B2 | 5/2006 | Bordon-Pallier et al. |
| 7,044,945 B2 | 5/2006 | Sand |
| 7,056,704 B2 | 6/2006 | Tuschl et al. |
| 7,078,196 B2 | 7/2006 | Tuschl et al. |
| 7,108,721 B2 | 9/2006 | Huckle et al. |
| 7,115,390 B1 | 10/2006 | Grotendorst et al. |
| 7,205,297 B2 | 4/2007 | Beauchamp et al. |
| 7,309,361 B2 | 12/2007 | Wasielewski |
| 7,348,155 B2 | 3/2008 | Kostenis et al. |
| 7,358,351 B2 | 4/2008 | St. Croix et al. |
| 7,384,634 B2 | 6/2008 | Grotendorst et al. |
| 7,393,932 B2 | 7/2008 | Carson-Walter et al. |
| 7,402,660 B2 | 7/2008 | St. Croix et al. |
| 7,405,274 B2 | 7/2008 | Lin et al. |
| 7,432,250 B2 | 10/2008 | Crooke |
| 7,462,602 B2 | 12/2008 | Schultz et al. |
| 7,504,493 B2 | 3/2009 | Velculescu et al. |
| 7,538,095 B2 | 5/2009 | Fire et al. |
| 7,560,438 B2 | 7/2009 | Fire et al. |
| 7,595,387 B2 | 9/2009 | Leake et al. |
| 7,622,633 B2 | 11/2009 | Fire et al. |
| 7,629,321 B2 | 12/2009 | Crooke |
| 7,655,785 B1 | 2/2010 | Bentwich |
| 7,687,616 B1 | 3/2010 | Bentwich et al. |
| 7,695,902 B2 | 4/2010 | Crooke |
| 7,709,630 B2 | 5/2010 | Gaarde et al. |
| 7,745,608 B2 | 6/2010 | Manoharan et al. |
| 7,750,144 B2 | 7/2010 | Zamore et al. |
| 7,777,022 B2 | 8/2010 | Bentwich et al. |
| 7,786,290 B2 | 8/2010 | Woppmann et al. |
| 7,829,693 B2 | 11/2010 | Kreutzer et al. |
| 7,833,989 B2 | 11/2010 | Khvorova et al. |
| 7,838,507 B2 | 11/2010 | Shepard et al. |
| 8,110,674 B2 | 2/2012 | Manoharan et al. |
| 8,258,105 B2 | 9/2012 | Siwkowski et al. |
| 8,263,569 B2 | 9/2012 | Baulcombe et al. |
| 8,329,671 B2 | 12/2012 | Gu et al. |
| 8,664,189 B2 | 3/2014 | Khvorova et al. |
| 8,796,443 B2 | 8/2014 | Khvorova et al. |
| 8,815,818 B2 | 8/2014 | Samarsky et al. |
| 9,074,211 B2 | 7/2015 | Woolf et al. |
| 9,080,171 B2 | 7/2015 | Khvorova et al. |
| 9,095,504 B2 | 8/2015 | Libertine et al. |
| 9,175,289 B2 | 11/2015 | Khvorova et al. |
| 2002/0086013 A1 | 7/2002 | King |
| 2002/0132788 A1 | 9/2002 | Lewis et al. |
| 2002/0147332 A1 | 10/2002 | Kaneko et al. |
| 2002/0160393 A1 | 10/2002 | Symonds et al. |
| 2002/0162126 A1 | 10/2002 | Beach et al. |
| 2003/0004325 A1 | 1/2003 | Cook et al. |
| 2003/0077829 A1 | 4/2003 | MacLachlan |
| 2003/0108923 A1 | 6/2003 | Tuschl et al. |
| 2003/0113816 A1 | 6/2003 | Weitz et al. |

(56) References Cited

U.S. PATENT DOCUMENTS

| | | |
|---|---|---|
| 2003/0139585 A1 | 7/2003 | Uhlmann et al. |
| 2003/0144223 A1 | 7/2003 | Gaarde et al. |
| 2003/0153524 A1 | 8/2003 | Hinton et al. |
| 2003/0157030 A1 | 8/2003 | Davis et al. |
| 2003/0158403 A1 | 8/2003 | Manoharan et al. |
| 2003/0166282 A1 | 9/2003 | Brown et al. |
| 2003/0180300 A1 | 9/2003 | Grotendorst et al. |
| 2004/0005319 A1 | 1/2004 | Grotendorst et al. |
| 2004/0009938 A1 | 1/2004 | Manoharan et al. |
| 2004/0014956 A1 | 1/2004 | Woolf et al. |
| 2004/0014957 A1 | 1/2004 | Eldrup et al. |
| 2004/0018999 A1 | 1/2004 | Beach et al. |
| 2004/0054155 A1 | 3/2004 | Woolf et al. |
| 2004/0063654 A1 | 4/2004 | Davis et al. |
| 2004/0072785 A1 | 4/2004 | Wolff et al. |
| 2004/0092450 A1 | 5/2004 | Grotendorst et al. |
| 2004/0137471 A1 | 7/2004 | Vickers et al. |
| 2004/0162235 A1 | 8/2004 | Trubetskoy et al. |
| 2004/0167090 A1 | 8/2004 | Monahan et al. |
| 2004/0171033 A1 | 9/2004 | Baker et al. |
| 2004/0180351 A1 | 9/2004 | Giese et al. |
| 2004/0192629 A1 | 9/2004 | Xu et al. |
| 2004/0204377 A1 | 10/2004 | Rana |
| 2004/0229266 A1 | 11/2004 | Tuschl et al. |
| 2004/0235031 A1 | 11/2004 | Schultz et al. |
| 2004/0241845 A1 | 12/2004 | Desgroseillers et al. |
| 2004/0248839 A1 | 12/2004 | Kowalik |
| 2004/0259247 A1 | 12/2004 | Tuschl et al. |
| 2005/0020521 A1 | 1/2005 | Rana |
| 2005/0026286 A1 | 2/2005 | Chi et al. |
| 2005/0032733 A1 | 2/2005 | McSwiggen et al. |
| 2005/0037496 A1 | 2/2005 | Rozema et al. |
| 2005/0042227 A1 | 2/2005 | Zankel et al. |
| 2005/0059629 A1 | 3/2005 | Gaarde et al. |
| 2005/0064595 A1 | 3/2005 | MacLachlan et al. |
| 2005/0080246 A1 | 4/2005 | Allerson et al. |
| 2005/0107325 A1 | 5/2005 | Manoharan et al. |
| 2005/0118625 A1 | 6/2005 | Mounts |
| 2005/0119202 A1 | 6/2005 | Kreutzer et al. |
| 2005/0142535 A1 | 6/2005 | Damha et al. |
| 2005/0181382 A1 | 8/2005 | Zamore et al. |
| 2005/0222071 A1 | 10/2005 | Duranton et al. |
| 2005/0245474 A1 | 11/2005 | Baker et al. |
| 2005/0255487 A1 | 11/2005 | Khvorova et al. |
| 2005/0265957 A1 | 12/2005 | Monahan et al. |
| 2005/0281781 A1 | 12/2005 | Ostroff |
| 2006/0008910 A1 | 1/2006 | MacLachlan et al. |
| 2006/0009409 A1 | 1/2006 | Woolf |
| 2006/0025363 A1 | 2/2006 | Breitenbach et al. |
| 2006/0035344 A1 | 2/2006 | Pachuk et al. |
| 2006/0069050 A1 | 3/2006 | Rana |
| 2006/0127891 A1 | 6/2006 | McSwiggen et al. |
| 2006/0142228 A1 | 6/2006 | Ford et al. |
| 2006/0178324 A1 | 8/2006 | Hadwiger et al. |
| 2006/0178327 A1 | 8/2006 | Yeung |
| 2006/0211642 A1 | 9/2006 | McSwiggen et al. |
| 2006/0240093 A1 | 10/2006 | MacLachlan et al. |
| 2007/0020623 A1 | 1/2007 | Petersohn et al. |
| 2007/0032441 A1 | 2/2007 | McSwiggen et al. |
| 2007/0042381 A1 | 2/2007 | Bentwich et al. |
| 2007/0054271 A1 | 3/2007 | Polyak et al. |
| 2007/0128294 A1 | 6/2007 | Bucalo et al. |
| 2007/0166734 A1 | 7/2007 | Bhat et al. |
| 2007/0173476 A1 | 7/2007 | Leake et al. |
| 2007/0231392 A1 | 10/2007 | Wagner et al. |
| 2007/0254850 A1 | 11/2007 | Lieberman et al. |
| 2007/0269889 A1 | 11/2007 | Leake et al. |
| 2008/0015114 A1 | 1/2008 | Khvorova et al. |
| 2008/0038296 A1 | 2/2008 | Brahmbhatt et al. |
| 2008/0070856 A1 | 3/2008 | Kreutzer et al. |
| 2008/0071068 A1 | 3/2008 | Oba et al. |
| 2008/0085869 A1 | 4/2008 | Yamada et al. |
| 2008/0107694 A1 | 5/2008 | Trogden et al. |
| 2008/0112916 A1 | 5/2008 | Wagner et al. |
| 2008/0152661 A1 | 6/2008 | Rozema et al. |
| 2008/0193443 A1 | 8/2008 | Beskrovnaya et al. |
| 2008/0254487 A1 | 10/2008 | Klaus et al. |
| 2008/0300147 A1 | 12/2008 | Chegini et al. |
| 2008/0311040 A1 | 12/2008 | Berry et al. |
| 2009/0023216 A1 | 1/2009 | Woolf |
| 2009/0069623 A1 | 3/2009 | Oh et al. |
| 2009/0131360 A1 | 5/2009 | Woolf et al. |
| 2009/0156524 A1 | 6/2009 | Feinstein et al. |
| 2009/0186802 A1 | 7/2009 | Alluis et al. |
| 2009/0202520 A1 | 8/2009 | Lupher, Jr. et al. |
| 2009/0208564 A1 | 8/2009 | Li et al. |
| 2009/0239934 A1 | 9/2009 | Schmitt-Milas |
| 2009/0298916 A1 | 12/2009 | Kauppinen et al. |
| 2009/0306005 A1 | 12/2009 | Bhanot et al. |
| 2010/0035964 A1 | 2/2010 | Gaarde et al. |
| 2010/0040656 A1 | 2/2010 | Franklin et al. |
| 2010/0069620 A1 | 3/2010 | Zon |
| 2010/0130595 A1 | 5/2010 | Dean et al. |
| 2010/0136695 A1 | 6/2010 | Woolf |
| 2010/0158907 A1 | 6/2010 | Grotendorst et al. |
| 2010/0190838 A1 | 7/2010 | Grotendorst |
| 2010/0286234 A1 | 11/2010 | Elmen et al. |
| 2011/0039914 A1 | 2/2011 | Pavco et al. |
| 2011/0054004 A1 | 3/2011 | Mustoe et al. |
| 2011/0237522 A1 | 9/2011 | Khvorova et al. |
| 2011/0237648 A1 | 9/2011 | Khvorova et al. |
| 2011/0251258 A1 | 10/2011 | Samarsky et al. |
| 2011/0263680 A1 | 10/2011 | Khvorova et al. |
| 2012/0016005 A1 | 1/2012 | Samarsky et al. |
| 2012/0040459 A1 | 2/2012 | Khvorova et al. |
| 2012/0059046 A1 | 3/2012 | Woolf et al. |
| 2012/0065243 A1 | 3/2012 | Woolf et al. |
| 2013/0131141 A1 | 5/2013 | Khvorova et al. |
| 2013/0131142 A1 | 5/2013 | Libertine et al. |
| 2013/0197055 A1 | 8/2013 | Kamens et al. |
| 2014/0315974 A1 | 10/2014 | Khvorova et al. |

FOREIGN PATENT DOCUMENTS

| | | |
|---|---|---|
| EP | 1 605 978 B1 | 9/2010 |
| JP | 2003-516716 | 5/2003 |
| JP | 2004-500846 | 1/2004 |
| JP | 4 095 895 B2 | 9/2004 |
| JP | 2004-527210 | 9/2004 |
| JP | 2004-533825 | 11/2004 |
| JP | 2005-512976 | 5/2005 |
| JP | 2009-519033 | 5/2009 |
| WO | WO 90/14074 A1 | 11/1990 |
| WO | WO 91/16024 A1 | 10/1991 |
| WO | WO 91/17424 A1 | 11/1991 |
| WO | WO 92/03464 A1 | 3/1992 |
| WO | WO 94/08003 A1 | 4/1994 |
| WO | WO 94/23028 A2 | 10/1994 |
| WO | WO 95/11910 A1 | 5/1995 |
| WO | WO 95/22553 A1 | 8/1995 |
| WO | WO 95/23162 A1 | 8/1995 |
| WO | WO 96/40964 A2 | 12/1996 |
| WO | WO 99/13915 A1 | 3/1999 |
| WO | WO 01/85941 A2 | 11/2001 |
| WO | WO 02/10217 A2 | 2/2002 |
| WO | WO 02/053773 A2 | 7/2002 |
| WO | WO 02/053774 A2 | 7/2002 |
| WO | WO 03/012052 A2 | 2/2003 |
| WO | WO 03/053340 A2 | 7/2003 |
| WO | WO 2004/065600 A2 | 8/2004 |
| WO | WO 2004/065601 A2 | 8/2004 |
| WO | WO 2004/090105 A2 | 10/2004 |
| WO | WO 2005/019430 A2 | 3/2005 |
| WO | WO 2005/019453 A2 | 3/2005 |
| WO | WO 2006/007372 A2 | 1/2006 |
| WO | WO 2006/019430 A2 | 2/2006 |
| WO | WO 2006/128141 A2 | 11/2006 |
| WO | WO 2007/030167 A1 | 3/2007 |
| WO | WO 2007/050643 A2 | 5/2007 |
| WO | WO 2008/021157 A1 | 2/2008 |
| WO | WO 2008/036825 A2 | 3/2008 |
| WO | WO 2009/005813 A1 | 1/2009 |
| WO | WO 2009/020344 A2 | 2/2009 |
| WO | WO 2009/021157 A1 | 2/2009 |

(56) References Cited

FOREIGN PATENT DOCUMENTS

| WO | WO 2009/029688 A3 | 3/2009 | |
|---|---|---|---|
| WO | WO 2009/029690 A1 | 3/2009 | |
| WO | WO 2009/043392 A2 * | 4/2009 | ............. 514/44 |
| WO | WO 2009/078685 A2 | 6/2009 | |
| WO | WO 2009/102427 A2 | 8/2009 | |
| WO | WO 2009/126933 A2 | 10/2009 | |
| WO | WO 2009/134487 A2 | 11/2009 | |
| WO | WO 2010/027830 A2 | 3/2010 | |
| WO | WO 2010/027831 A1 | 3/2010 | |
| WO | WO 2010/027832 A1 | 3/2010 | |
| WO | WO 2010/033246 A1 | 3/2010 | |
| WO | WO 2010/033247 A2 | 3/2010 | |
| WO | WO 2010/033248 A2 | 3/2010 | |
| WO | WO 2010/042281 A2 | 4/2010 | |
| WO | WO 2011/109698 A1 | 9/2011 | |
| WO | WO 2012/106508 A1 | 8/2012 | |

OTHER PUBLICATIONS

Alahari et al, Inhibition of expression of the multidrug resistance-associated P-glycoprotein of by phosphorothioate and 5' cholesterol-conjugated phosphorothioate antisense oligonucleotides. Mol Pharmacol. Oct. 1996;50(4):808-19.
Aleckovic et al., RNAi at Oxford. J RNAi Gene Silencing. May 27, 2008;4(1):266-8.
Baigude et al., Design and creation of new nanomaterials for therapeutic RNAi. ACS Chem Biol. Apr. 24, 2007;2(4):237-41.
Boutorin et al., Synthesis of alkylating oligonucleotide derivatives containing cholesterol or phenazinium residues at their 3'-terminus and their interaction with DNA within mammalian cells. FEBS Lett. Aug. 28, 1989;254(1-2):129-32.
Brown et al., RNAi off-targeting: Light at the end of the tunnel. J RNAi Gene Silencing. Jul. 28, 2006;2(2):175-7.
Cardia et al., Novel self-delivering RNAi compounds with enhanced cellular uptake and distribution properties. RXI Keystone RNAi Silencing Conference. Jan. 14-19, 2010. Poster. 1 Page.
Cheng et al., Connective tissue growth factor is a biomarker and mediator of kidney allograft fibrosis. Am J Transplant. Oct. 2009;6(10):2292-306. Epub Aug. 4, 2006.
Choung et al., Chemical modification of siRNAs to improve serum stability without loss of efficacy. Biochem Biophys Res Commun. Apr. 14, 2006;342(3):919-27.
Chu et al., Potent RNAi by short RNA triggers. RNA. 2008;14:1714-9.
Cicha et al., Connective tissue growth factor is overexpressed in complicated atherosclerotic plaques and induces mononuclear cell chemotaxis in vitro. Arterioscler Thromb Vasc Biol. May 2005;25(5):1008-13. Epub Mar. 10, 2005.
Czauderna et al., ., Structural variations and stabilising modifications of synthetic siRNAs in mammalian cells. Nucleic Acids Res. Jun. 1, 2003;31(11):2705-16.
Daniels et al, Imatinib mesylate inhibits the profibrogenic activity of TGF-beta and prevents bleomycin-mediated lung fibrosis. J Clin Invest. Nov. 2004;114(9):1308-16.
De Smidt et al., Association of antisense oligonucleotides with lipoproteins prolongs the plasma half-life and modifies the tissue distribution. Nucleic Acids Res. Sep. 11, 1991;19(17):4695-700.
Distler et al, Imatinib mesylate reduces production of extracellular matrix and prevents development of experimental dermal fibrosis. Arthritis Rheum. Jan. 2007;56(1):311-22.
Dranoff et al., Prevention of liver fibrosis by the purinoceptor antagonist pyridoxal-phosphate-6-2',4'-disulfonate (PPADS). In Vivo. 2007;21:957-66.
Dykxhoorn et al., The silent treatment: siRNAs as small molecule drugs. Gene Ther. Mar. 2006;13(6):541-52. Review.
Dziadzio et al., N-terminal connective tissue growth factor is a marker of the fibrotic phenotype in scleroderma. QJM. Jul. 2005;98(7):485-92. Epub Jun. 13, 2005.

Elbashir et al., Duplexes of 21-nucleotide RNAs mediate RNA interference in cultured mammalian cells. Nature. May 24, 2001;411(6836):494-8.
Elbashir et al., Functional anatomy of siRNAs for mediating efficient RNAi in Drosophila melanogaster embryo lysate. EMBO J. Dec. 3, 2001;20(23):6877-88.
Fedorov et al., Off-target effects by siRNA can induce toxic phenotype. RNA. Jul. 2006;12(7):1188-96. Epub May 8, 2006.
Gressner et al., Connective tissue growth factor in serum as a new candidate test for assessment of hepatic fibrosis. Clin Chem. Sep. 2006;52(9):1815-7. Epub Jul. 20, 2006.
Gressner et al., Connective tissue growth factor: a fibrogenic master switch in fibrotic liver diseases. Liver Int. Sep. 2008;28(8):1065-79. doi:10.1111/j.1478-3231.2008.01826.x.
Hinton et al., Novel growth factors involved in the pathogenesis of proliferative vitreoretinopathy. Eye (Lond). Jul. 2002;16(4):422-8.
Ito et al., Expression of connective tissue growth factor in human renal fibrosis. Kidney Int. Apr. 1998;53(4):853-61.
Ito et al., Kinetics of connective tissue growth factor expression during experimental proliferative glomerulonephritis. J Am Soc Nephrol. Mar. 2001;12(3):472-84.
Kamens et al., Novel, chemically modified RNAi compounds with improved potency, stability and specificity. RXI Keystone RNAi Silencing: Mechanism, Biology and Application Conference. Jan. 14-19, 2010. Poster. 1 Page.
Kim et al., Synthetic dsRNA Dicer substrates enhance RNAi potency and efficacy. Nat Biotechnol. Feb. 2005;23(2):222-6. Epub Dec. 26, 2004.
Kim et al., Systemic and specific delivery of small interfering RNAs to the liver mediated by apolipoprotein A-I. Mol Ther. Jun. 2007;15(6):1145-52. Epub Apr. 17, 2007.
Koitabashi et al., Plasma connective tissue growth factor is a novel potential biomarker of cardiac dysfunction in patients with chronic heart failure. Eur J Heart Fail. Apr. 2008;10(4):373-9. doi: 10.1016/j.ejheart.2008.02.011.
Kraynack et al., Small interfering RNAs containing full 2'-O-methylribonucleotide-modified sense strands display Argonaute2/eIF2C2-dependent activity. RNA. Jan. 2006;12(1):163-76. Epub Nov. 21, 2005.
Kubo et al., Modified 27-nt dsRNAs with dramatically enhanced stability in serum and long-term RNAi activity. Oligonucleotides. 2007 Winter;17(4):445-64.
Layzer et al., In vivo activity of nuclease-resistant siRNAs. RNA. May 2004;10(5):766-71.
Leask et al., Connective tissue growth factor (CTGF, CCN2) gene regulation: a potent clinical bio-marker of fibroproliferative disease? J Cell Commun Signal. Jun. 2009;3(2):89-94. Epub 2009 Jan. 21, 2009.
Leask et al., Insights into the molecular mechanism of chronic fibrosis: the role of connective tissue growth factor in scleroderma. J Invest Dermatol. Jan. 2004;122(1):1-6.
Lee et al., Contributions of 3'-overhang to the dissociation of small interfering RNAs from the PAZ domain: molecular dynamics simulation study. J Mol Graph Model. Mar. 2007;25(6):784-93. Epub Jul. 11, 2006.
Letsinger et al., Cholesteryl-conjugated oligonucleotides: synthesis, properties, and activity as inhibitors of replication of human immunodeficiency virus in cell culture. Proc Natl Acad Sci U S A. Sep. 1989;86(17):6553-6.
Li et al., Inhibition of connective tissue growth factor by siRNA prevents liver fibrosis in rats. J Gene Med. Jul. 2006;8(7):889-900.
Li et al., Surface-modified LPD nanoparticles for tumor targeting. Ann N Y Acad Sci. Oct. 2006;1082:1-8.
Liu et al., Role of connective tissue growth factor in experimental radiation nephropathy in rats. Chin Med J (Engl). Oct. 5, 2008;121(19):1925-31.
Luo et al, Inhibition of connective tissue growth factor by small interfering RNA prevents renal fibrosis in rats undergoing chronic allograft nephropathy. Transplant Proc. Sep. 2008;40(7):2365-9. doi:10.1016/j.transproceed.2008.07.100.
Macrae et al., Structure of Dicer and mechanistic implications for RNAi. Cold Spring Harb Symp Quant Biol. 2006;71:73-80.

(56) References Cited

OTHER PUBLICATIONS

Manoharan et al., Chemical modifications to improve uptake and bioavailability of antisense oligonucleotides. Ann N Y Acad Sci. Oct. 28, 1992;660:306-9.
Manoharan, Oligonucleotide conjugates as potential antisense drugs with improved uptake, biodistribution, targeted delivery, and mechanism of action. Antisense Nucleic Acid Drug Dev. Apr. 2002;12(2):103-28.
Martins et al., Sterol side chain length and structure affect the clearance of chylomicron-like lipid emulsions in rats and mice. J Lipid Res. Feb. 1998;39(2):302-12.
Murchison et al., Characterization of Dicer-deficient murine embryonic stem cells. Proc Natl Acad Sci U S A. Aug. 23, 2005;102(34):12135-40. Epub Aug. 12, 2005.
Niessen et al., Keratinocyte-derived growth factors play a role in the formation of hypertrophic scars. J Pathol. Jun. 2001;194(2):207-16.
Oberhauser et al., Effective incorporation of 2'-O-methyl-oligoribonucleotides into liposomes and enhanced cell association through modification with thiocholesterol. Nucleic Acids Res. Feb. 11, 1992;20(3):533-8.
Paradis et al., Expression of connective tissue growth factor in experimental rat and human liver fibrosis. Hepatology. Oct. 1999;30(4):968-76.
Parrish et al., Functional anatomy of a dsRNA trigger: differential requirement for the two trigger strands in RNA interference. Mol Cell. Nov. 2000;6(5):1077-87.
Pavco et al., Robust Intradermal efficacy with novel chemically modified self-delivering RNAi compounds. RXI Keystone RNAi Silencing: Mechanism, Biology and Application Conference. Jan. 14-19, 2010. Poster. 1 Page.
Rump et al., Preparation of conjugates of oligodeoxynucleotides and lipid structures and their interaction with low-density lipoprotein. Bioconjug Chem. May-Jun. 1998;9(3):341-9.
Salomon et al., Modified dsRNAs that are not processed by Dicer maintain potency and are incorporated into the RISC. Nucleic Acids Res. Jun. 2010;38(11):3771-9. doi: 10.1093/nar/gkq055. Epub Feb. 18, 2010.
Sato et al., Serum levels of connective tissue growth factor are elevated in patients with systemic sclerosis: association with extent of skin sclerosis and severity of pulmonary fibrosis. J Rheumatol. Jan. 2000;27(1):149-54.
Shi, Mammalian RNAi for the masses. Trends Genet. Jan. 2003;19(1):9-12.
Shi-Wen et al., Regulation and function of connective tissue growth factor/CCN2 in tissue repair, scarring and fibrosis. Cytokine Growth Factor Rev. Apr. 2008;19(2):133-44. doi: 10.1016/j.cytogfr.2008.01.002.
Sisco et al., Antisense inhibition of connective tissue growth factor (CTGF/CCN2) mRNA limits hypertrophic scarring without affecting wound healing in vivo. Wound Repair Regen. Sep.-Oct. 2008;16(5):661-73. doi:10.1111/j.1524-475X.2008.00416.x.
Soutschek et al., Therapeutic silencing of an endogenous gene by systemic administration of modified siRNAs. Nature. 2004 Nov. 11, 2004;432(7014):173-8.
Sui et al., A DNA vector-based RNAi technology to suppress gene expression in mammalian cells. Proc Natl Acad Sci U S A. Apr. 16, 2002;99(8):5515-20.
Sun et al., Asymmetric Rna duplexes mediate RNA interference in mammalian cells. Nat Biotechnol. Dec. 2008;26(12):1379-82. doi: 10.1038/nbt.1512. Epub Nov. 23, 2008.
Williams et al., Increased expression of connective tissue growth factor in fibrotic human liver and in activated hepatic stellate cells. J Hepatol. May 2000;32(5):754-61.
Wolfrum et al., Mechanisms and optimization of in vivo delivery of lipophilic siRNAs. Nat Biotechnol. Oct. 2007;25(10):1149-57. Epub Sep. 16, 2007.
Xiao et al., Effect of small interfering RNA on the expression of connective tissue growth factor and type I and III collagen in skin fibroblasts of patients with systemic sclerosis. Br J Dermatol. Dec. 2006;155(6):1145-53.
Yu et al., RNA interference by expression of short-interfering RNAs and hairpin RNAs in mammalian cells. Proc Natl Acad Sci U S A. Apr. 30, 2002;99(9):6047-52. Epub Apr. 23, 2002.
[No Author Listed], RXi Pharmaceuticals Presents Self-Delivering RNAi Data at Scar Club Meeting in France. Drugs.com. Mar. 26, 2010. http://www.drugs.com/clinical_trials/rxi-pharmaceuticals-presents-self-delivering-rnai-data-scar-club-meeting-france-9093.html [last accessed Aug. 19, 2014].
Braasch et al., RNA interference in mammalian cells by chemically-modified RNA. Biochemistry. Jul. 8, 2003;42(26):7967-75.
Choi et al., Control of scarring in adult wounds using antisense transforming growth factor-beta 1 oligodeoxynucleotides. Immunol Cell Biol. Apr. 1996;74(2):144-50.
Cordiero et al., Novel antisense oligonucleotides targeting TGF-beta inhibit in vivo scarring and improve surgical outcome. Gene Ther. Jan. 2003;10(1):59-71.
Debart et al., Chemical modifications to improve the cellular uptake of oligonucleotides. Curr Top Med Chem. 2007;7(7):727-37.
Ferentz et al., Disulfide-crosslinked oligonucleotides. Journal of the American Chemical Society. 1991;113 (10): 4000-4002.
Ferguson et al., Scar-free healing: from embryonic mechanisms to adult therapeutic intervention. Philos Trans R Soc Lond B Biol Sci. May 29, 2004;359(1445):839-50.
Jackson et al., Position-specific chemical modification of siRNAs reduces "off-target" transcript silencing. RNA. Jul. 2006;12(7):1197-1205. Epub May 8, 2006.
Leuschner et al., Cleavage of the siRNA passenger strand during RISC assembly in human cells. EMBO Reports 2006;7(3):314-20.
Lynch et al., Role of platelet-derived growth factor in wound healing: synergistic effects with other growth factors. Proc Natl Acad Sci U S A. Nov. 1987;84(21):7696-700.
Mathews et al., Incorporating chemical modification constraints into a dynamic programming algorithm for prediction of RNA secondary structure. Proc Natl Acad Sci U S A. May 11, 2004;101(19):7287-92. Epub May 3, 2004.
Mescalchin et al., Cellular uptake and intracellular release are major obstacles to the therapeutic application of siRNA: novel options by phosphorothioate-stimulated delivery. Expert Opin Biol Ther. Oct. 2007;7(10):1531-8. Review.
Mori et al., Molecular mechanisms linking wound inflammation and fibrosis: knockdown of osteopontin leads to rapid repair and reduced scarring. J Exp Med. Jan. 21, 2008;205(1):43-51. doi: 10.1084/jem.20071412. Epub Jan. 7, 2008.
Overhoff et al., Phosphorothioate-stimulated uptake of short interfering RNA by human cells. EMBO Rep. Dec. 2005;6(12):1176-81.
Pollio et al., Severe secondary postpartum hemorrhage 3 weeks after cesarean section: alternative etiologies of uterine scar non-union. J Obstet Gynaecol Res. Jun. 2007;33(3):360-2.
Rajeev et al., 2'-modified-2-thiothymidine oligonucleotides. Org Lett. Aug. 21, 2003;5(17):3005-8.
Sato et al., Tumor targeting and imaging of intraperitoneal tumors by use of antisense oligo-DNA complexed with dendrimers and/or avidin in mice. Clin Cancer Res. Nov. 2001;7(11):3606-12.
Seela et al., Oligodeoxyribonucleotides containing 1,3-propanediol as nucleoside substitute. Nucleic Acids Res. Apr. 10, 1987;15(7):3113-29.
Shah et al., Neutralisation of TGF-beta 1 and TGF-beta 2 or exogenous addition of TGF-beta 3 to cutaneous rat wounds reduces scarring. J Cell Sci. Mar. 1995;108 ( Pt 3):985-1002.
Uhlmann et al., Antisense oligonucleotides: a new therapeutic principle. Chem Rev. 1990;90(4):543-84.
Yamada et al., Synthesis and properties of oligonucleotides having a chemically stable 2-(trimethylsilyl)benzoyl group. Nucleic Acids Symp Ser (Oxf). 2008;(52):301-2. doi: 10.1093/nass/nrn152.
Zhang et al., Mechanisms of hypoxic regulation of plasminogen activator inhibitor-1 gene expression in keloid fibroblasts. J Invest Dermatol. Nov. 2003;121(5):1005-12.
U.S. Appl. No. 15/041,738, filed Feb. 11, 2016, Khvorova et al.

\* cited by examiner

Figure 2

Local Delivery of sd-rxRNA: Visualization after Intradermal Injection

Study Design sd-rxRNA injection   sd-rxRNA injection

Day 1 — 2 — 3 — 4

Incision

Biopsy harvest

Single Injection Site

- 6 intradermal injections in each site
- ~34 ul/injection, 300 ug total
- Image taken before incision, 15 minutes after first injection

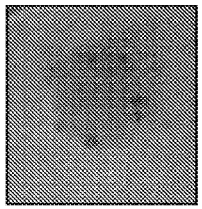

Incision Cross Section with Sirius Red Stain
(connective tissue in red)

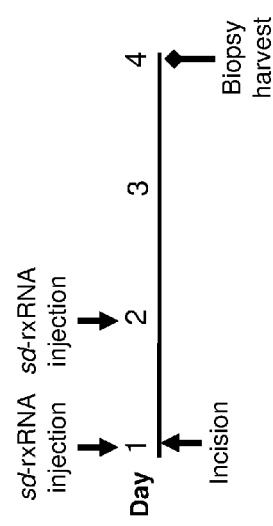

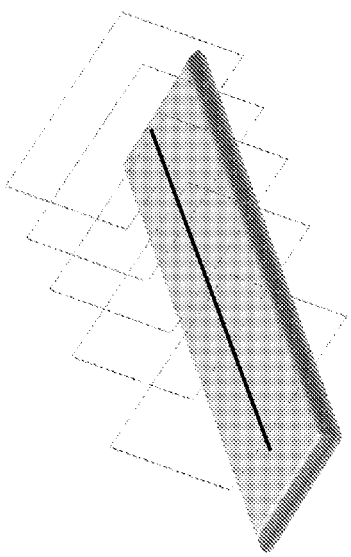

Biopsy Processing for Imaging

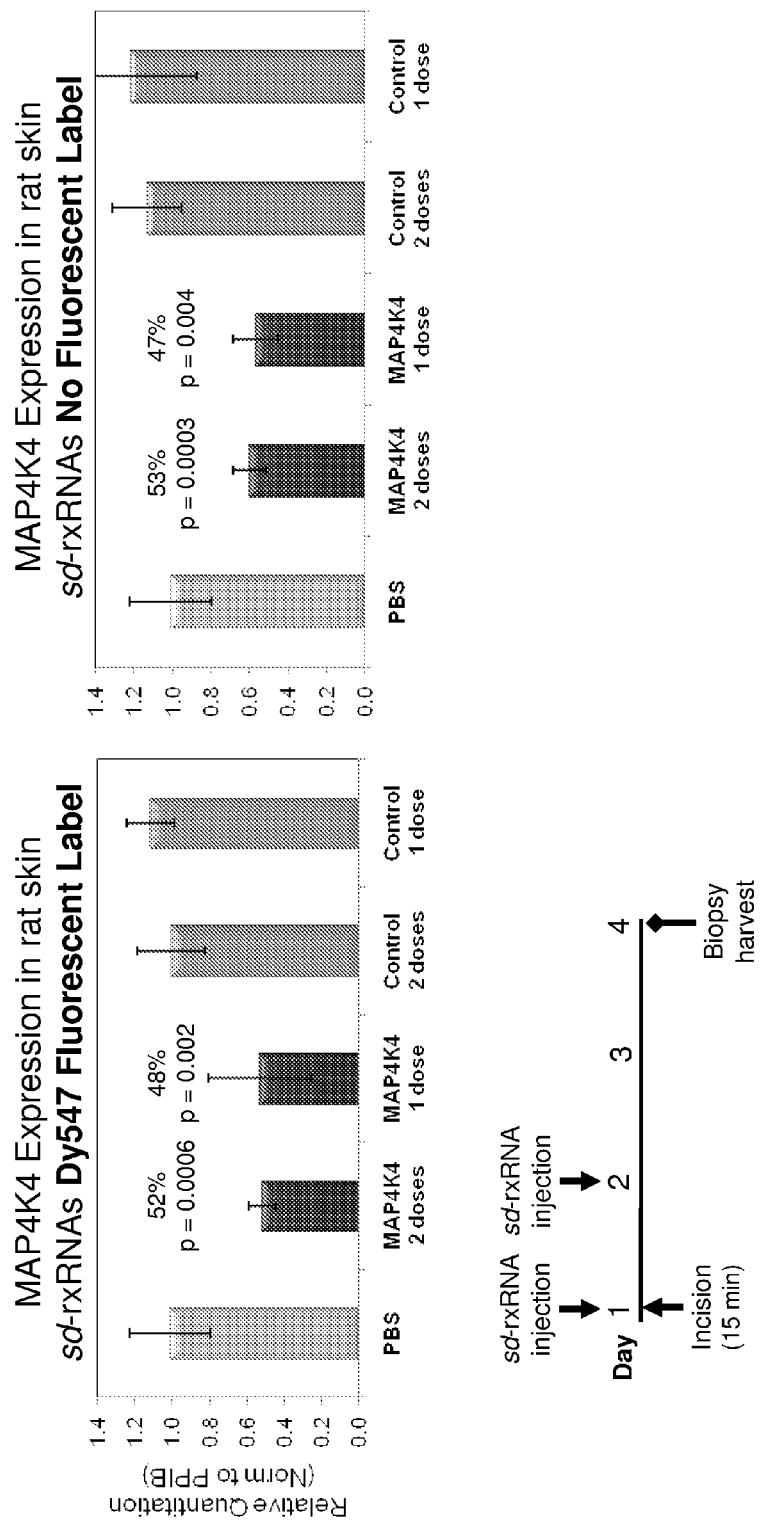

Efficient Silencing of a Second Target (PPIB) in Rat

*In vivo* Silencing in Mouse with *sd*-rxRNA Following Intradermal Injection

Silencing of PPIB and MAP4K4 in Mouse Skin by Intradermal Injection

Equivalent Silencing using a Different Dose Regimen (Days 1 and 3 vs Days 0 and 2)

CTGF sd-rxRNA are Efficacious

CTGF sd-rxRNA are Efficacious

Low Hit Rate with Original sd-rxRNA Screen

TGFB2 Continued

TGFB2 Continued

TGFB2 Continued

TGFB2 Continued

Identification of Potent hSPP1 sd-rxRNAs (A549, 48 hrs)

Identification of Potent hSPP1 sd-rxRNAs (A549, 48 hrs)

SPPI sd-rxRNA Compound Selection (A549 - Human cells)

sd-rxRNAs Containing Ribo Linker are Efficacious

CTGF: A Central Factor in the Pathway to Fibrosis

Chemical Optimization of sd-rxRNA Leads

- ● – 2'-O-Me
- ◎ – 2'-F
- ○ – 2'-OH
- * – phosphorothioate
- ⋯ – phosphodiester 13 bp duplex | 6 nt tail

Structural Characteristics
- Antisense strand: 19 bases
- Sense strand: 13 bases
- Duplex length: 13 bp
- Molecular weight: ~10kD

Chemical Characteristics
- 2'-O-Me: ~70%
- 2'-F: ~15%
- 2'-OH: ~15%
- PS: ~25%
- TEG
- Sterol CTGF L1 Chemical Optimization
(*in vitro* Efficacy)

CTGF L1 Chemical Optimization
(*in vitro* Stability)

0  0.5  2  8  24  48 Hrs

80 % Serum

CTGF L1 (un-optimized guide strand) $t_{1/2}$ ~ 15 hrs
P.mU.fU. A. G. A. A. A. G. G.fU. G.fC. A. A*A*fC* A. A* G* G CTFG L1a (guide strand) $t_{1/2}$ ~ 18 hrs
P.mU.fU. A. G. A.mA. A. G. G.fU. G.fC.mA.mA*mA*fC*mA*mA*mG* G.

CTGF L1b (guide strand) $t_{1/2}$ ~ 16 hrs
P.mU.fU. A. G. A.mA. A. G. G.fU. G.fC. A. A* A*fC* A*mA*mG* G.

CTGF L1c (guide strand) $t_{1/2}$ ~ 18 hrs
P.mU.fU. A. G. A.mA. A. G. G.fU. G.fC.mA. A*mA*fC* A*mA*mG* G.

CTGF L2 Chemical Optimization
(*in vitro* Efficacy)

CTGF L2 Chemical Optimization
(*in vitro* Stability)

Figure 39

Summary of in vivo active compounds

| Gene ID | Accession number | Duplex ID | Ref Site | Passenger Strand Sequence | Guide Strand Sequence | % Reduction in vivo | Notes |
|---|---|---|---|---|---|---|---|
| CTGF | NM_001901.2 | 17384 | 2275 | GUGACCAAAAGUA | UACUUUGGUCACACUCUC | 52% | single 600 ug injection |
| CTGF | NM_001901.2 | 21204 | 2296 | GCACCUUUCUAGA | UCUAGAAAGGUGCAAACAU | 67% | dosed (2) 600 ug 48 hours apart, silencing observed 5 days after last injection |
| CTGF | NM_001901.2 | 21214 | 2295 | UUGCACCUUUCUAA | UUAGAAAGGUGCAAACAAGG | 90% | single 600 ug injection |
| CTGF | NM_001901.2 | 17385 | 2277 | GACCAAAAGUUAA | UUAACUUUUGGUCACACUC | 50% | single 600 ug injection |
| CTGF | NM_001901.2 | 17387 | 2299 | CCUUUCUAGUUGA | UCAACUAGAAAGGUGCAAA | 73% | single 600 ug injection |
| rTGFB2 | NM_001135599.1 | 18935 | 1660 | CGGUGACAAUGAA | UUCAUUGUCACCGUGAUUU | 57% | single 600 ug injection |
| rTGFB2 | NM_001135599.1 | 18940 | 1654 | AAAUCACGGUGAA | UUCACCGUGAUUUUCAUCC | 29% | single 600 ug injection |
| rTGFB2 | NM_001135599.1 | 18947 | 2056 | UAUUGCUCUGCAA | UUGCAGAGCAAUACAGAGG | 50% | single 600 ug injection |
| rTGFB1 | NM_021578.2 | 20164 | 522 | CACACAGUAUAUA | UAUAUACUGUGUGUGAUGU | 38% | single 600 ug injection |
| PTGS2 | NM_000963.2 | 17393 | 448 | GAUCACAUUUGAA | UUCAAAUGUGAUCUGGAUG | 77% | single 600 ug injection |
| PTGS2 | NM_000963.2 | 17408 | 449 | GAUCACAUUUGAUA | UAUCAAAUGUGAUCUGGAU | 81% | single 600 ug injection |

Treatment with CTGF Lead 1B Resulted in mRNA Silencing

Treatment with CTGF L2 Target Sequence Results in CTGF mRNA Silencing

CTGF Silencing After Two Intradermal Injections of RXi-109 sd-rxRNA: Duration of Silencing in Skin

CTGF L3 Chemical Optimization

Figure 45
CTGF L4 Chemical Optimization
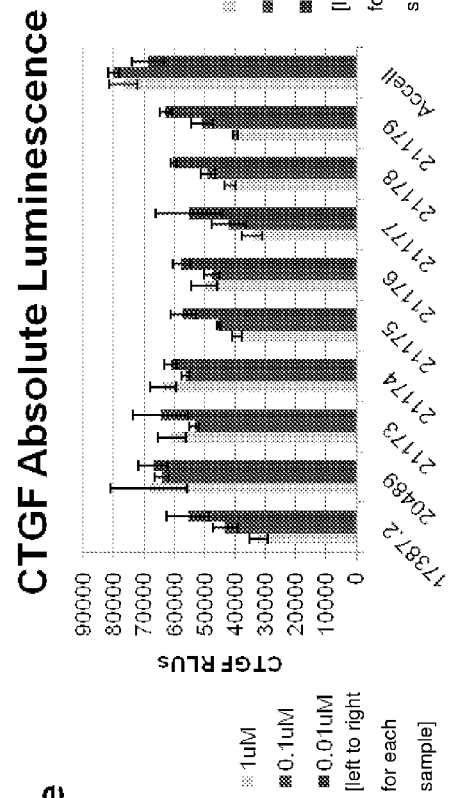
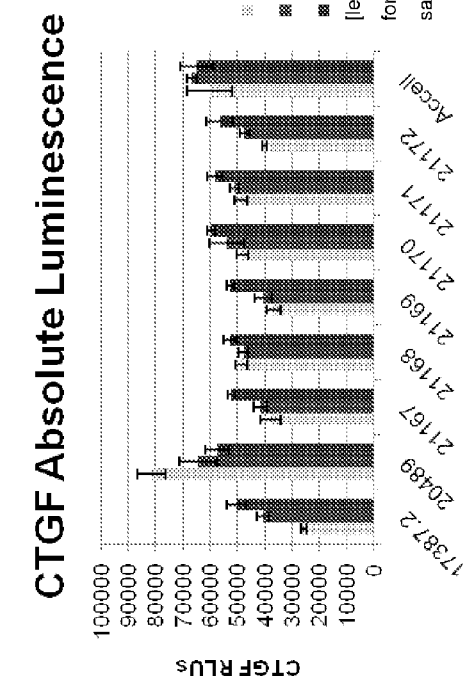

CTGF L4 Chemical Optimization

Epistem: Macroscopic Measure of Wound Healing

Epistem: Microscopic Wound Width Data

Epistem: Microscopic Wound Area Data

Epistem: Microscopic Re-epithelialization Data

Epistem: Microscopic Granulation Tissue Maturity Scores

Epistem: CD68 (Macrophage Marker) Immunohistochemistry

RXI 109 *in vitro* Dose Escalation – Oligos Formulated in PBS

Phase 1/2; Part A: Divided Dose, Single Day Ascending Dose Clinical Trial Design Phase 1/2; Part B: Divided Dose, Multi-day Ascending Dose Clinical Trial Design Liver Silencing after Systemic Delivery with Lipidoid Formulated rxRNAs

Figure 61
hTGFB1 L1 Chemical Optimization
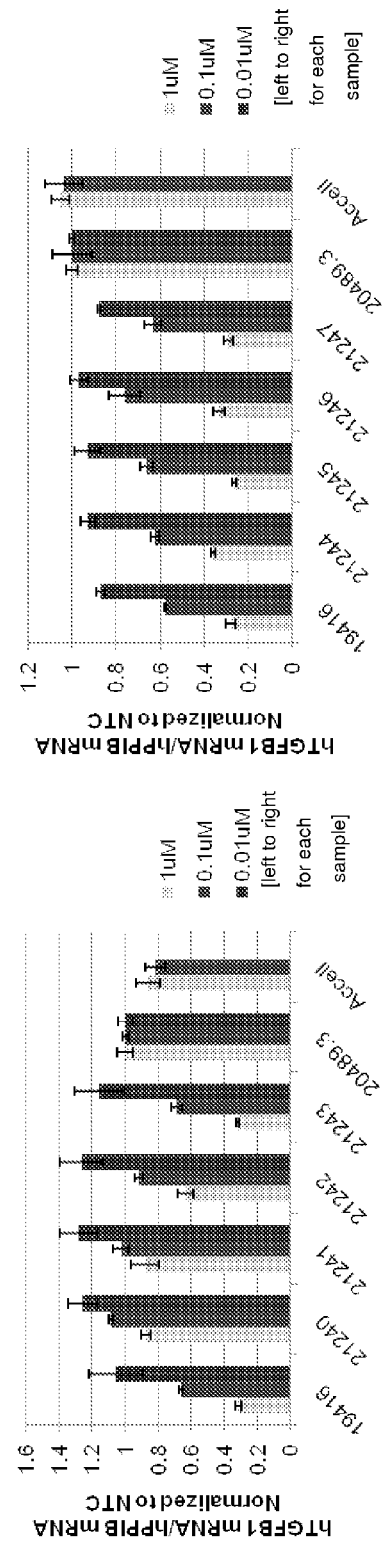
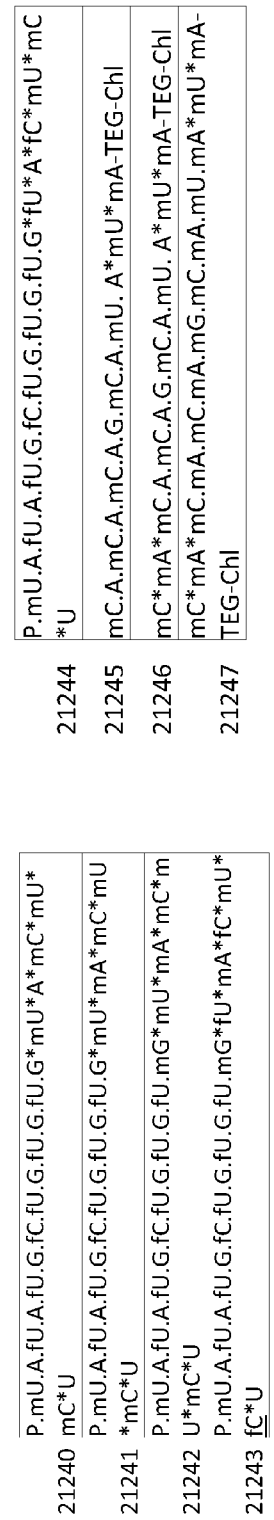

hTGFB2 L1 Chemical Optimization

RNA INTERFERENCE IN DERMAL AND FIBROTIC INDICATIONS

RELATED APPLICATIONS

This application is a National Stage Application of PCT/US2011/029867 which claims priority under 35 U.S.C. §119 (e) to U.S. 61/317,252, entitled "RNA INTERFERENCE IN SKIN INDICATIONS," filed on Mar. 24, 2010, and U.S. Provisional Application Ser. No. U.S. 61/317,633, entitled "RNA INTERFERENCE IN SKIN INDICATIONS," filed on Mar. 25, 2010, each of which are herein incorporated by reference in their entirety.

FIELD OF INVENTION

The invention pertains to the field of RNA interference (RNAi). The invention more specifically relates to nucleic acid molecules with improved in vivo delivery properties and their use for dermal and fibrotic indications.

BACKGROUND OF INVENTION

Complementary oligonucleotide sequences are promising therapeutic agents and useful research tools in elucidating gene functions. However, prior art oligonucleotide molecules suffer from several problems that may impede their clinical development, and frequently make it difficult to achieve intended efficient inhibition of gene expression (including protein synthesis) using such compositions in vivo.

A major problem has been the delivery of these compounds to cells and tissues. Conventional double-stranded RNAi compounds, 19-29 bases long, form a highly negatively-charged rigid helix of approximately 1.5 by 10-15 nm in size. This rod type molecule cannot get through the cell-membrane and as a result has very limited efficacy both in vitro and in vivo. As a result, all conventional RNAi compounds require some kind of a delivery vehicle to promote their tissue distribution and cellular uptake. This is considered to be a major limitation of the RNAi technology.

There have been previous attempts to apply chemical modifications to oligonucleotides to improve their cellular uptake properties. One such modification was the attachment of a cholesterol molecule to the oligonucleotide. A first report on this approach was by Letsinger et al., in 1989. Subsequently, ISIS Pharmaceuticals, Inc. (Carlsbad, Calif.) reported on more advanced techniques in attaching the cholesterol molecule to the oilgonucleotide (Manoharan, 1992).

With the discovery of siRNAs in the late nineties, similar types of modifications were attempted on these molecules to enhance their delivery profiles. Cholesterol molecules conjugated to slightly modified (Soutschek, 2004) and heavily modified (Wolfrum, 2007) siRNAs appeared in the literature. Yamada et al., 2008 also reported on the use of advanced linker chemistries which further improved cholesterol mediated uptake of siRNAs. In spite of all this effort, the uptake of these types of compounds appears to be inhibited in the presence of biological fluids resulting in highly limited efficacy in gene silencing in vivo, limiting the applicability of these compounds in a clinical setting.

SUMMARY OF INVENTION

Described herein is the efficient in vivo delivery of sd-rxRNA molecules to the skin and the use of such molecules for gene silencing. This class of RNAi molecules has superior efficacy both in vitro and in vivo than previously described RNAi molecules. Molecules associated with the invention have widespread potential as therapeutics for disorders or conditions associated with compromised skin and fibrosis.

Aspects of the invention relate to double-stranded ribonucleic acids (dsRNAs) including a sense strand and an antisense strand wherein the antisense strand is complementary to at least 12 contiguous nucleotides of a sequence selected from the sequences within Tables 2, 5, 6, 9, 11, 12, 13, 14, 15, 16, 17 and 23, and wherein the dsRNA is an sd-rxRNA.

Further aspects of the invention relate to double-stranded ribonucleic acids (dsRNAs) comprising a sense strand and an antisense strand wherein the sense strand and/or the antisense strand comprises at least 12 contiguous nucleotides of a sequence selected from the sequences within Tables 1-27, and wherein the dsRNA is an sd-rxRNA.

Further aspects of the invention relate to double-stranded ribonucleic acids (dsRNAs) comprising a sense strand and an antisense strand wherein the antisense strand is complementary to at least 12 contiguous nucleotides of a sequence selected from the sequences within Tables 2, 5, 6, 9, 11, 12, 13, 14, 15, 16, 17 and 23, and wherein the dsRNA is an rxRNAori.

Further aspects of the invention relate to double-stranded ribonucleic acids (dsRNAs) comprising a sense strand and an antisense strand wherein the sense strand and/or the antisense strand comprises at least 12 contiguous nucleotides of a sequence selected from the sequences within Tables 1-27, and wherein the dsRNA is an rxRNAori.

In some embodiments, the dsRNA is directed against CTGF. In some embodiments, the antisense strand of the dsRNA is complementary to at least 12 contiguous nucleotides of a sequence selected from the sequences within Tables 11, 12 and 15. In some embodiments, the sense strand and/or the antisense strand comprises at least 12 contiguous nucleotides of a sequence selected from the sequences within Tables 10, 11, 12, 15, 20 and 24.

In some embodiments, the sense strand comprises at least 12 contiguous nucleotides of a sequence selected from the group consisting of: SEQ ID NOs: 2463, 3429, 2443, 3445, 2459, 3493, 2465 and 3469. In some embodiments, the antisense strand comprises at least 12 contiguous nucleotides of a sequence selected from the group consisting of: 2464, 3430, 4203, 3446, 2460, 3494, 2466 and 3470.

In certain embodiments, the sense strand comprises SEQ ID NO:2463 and the antisense strand comprises SEQ ID NO:2464. In certain embodiments, the sense strand comprises SEQ ID NO:3429 and the antisense strand comprises SEQ ID NO:3430.

In certain embodiments, the sense strand comprises SEQ ID NO:2443 and the antisense strand comprises SEQ ID NO:4203. In certain embodiments, the sense strand comprises SEQ ID NO:3445 and the antisense strand comprises SEQ ID NO:3446.

In certain embodiments, the sense strand comprises SEQ ID NO:2459 and the antisense strand comprises SEQ ID NO:2460. In certain embodiments, the sense strand comprises SEQ ID NO:3493 and the antisense strand comprises SEQ ID NO:3494.

In certain embodiments, the sense strand comprises SEQ ID NO:2465 and the antisense strand comprises SEQ ID NO:2466. In certain embodiments, the sense strand comprises SEQ ID NO:3469 and the antisense strand comprises SEQ ID NO:3470.

In some embodiments, the sense strand comprises at least 12 contiguous nucleotides of a sequence selected from the group consisting of: SEQ ID NOs: 1835, 1847, 1848 and 1849. In certain embodiments, the sense strand comprises a sequence selected from the group consisting of: SEQ ID NOs: 1835, 1847, 1848 and 1849.

In some embodiments, the dsRNA is hydrophobically modified. In certain embodiments, the dsRNA is linked to a hydrophobic conjugate.

Aspects of the invention relate to compositions comprising the dsRNA described herein. In some embodiments, the composition comprises dsRNA directed against genes encoding for more than one protein.

In some embodiments, the composition is formulated for delivery to the skin. In certain embodiments, the composition is in a neutral formulation. In some embodiments, the composition is formulated for topical delivery or for intradermal injection.

Aspects of the invention relate to methods comprising delivering any of the dsRNA described herein or a composition comprising any of the dsRNA described herein to the skin of a subject in need thereof.

Aspects of the invention relate to methods comprising administering to a subject in need thereof a therapeutically effective amount of a double stranded ribonucleic acid (dsRNA) comprising a sense strand and an antisense strand wherein the antisense strand is complementary to at least 12 contiguous nucleotides of a sequence selected from the sequences within Tables 2, 5, 6, 9, 11, 12, 13, 14, 15, 16, 17 and 23, and wherein the dsRNA is an sd-rxRNA.

Further aspects of the invention relate to methods comprising administering to a subject in need thereof a therapeutically effective amount of a double stranded ribonucleic acid (dsRNA) comprising a sense strand and an antisense strand wherein the sense strand and/or the antisense strand comprises at least 12 contiguous nucleotides of a sequence selected from the sequences within Tables 1-27, and wherein the dsRNA is an sd-rxRNA.

Further aspects of the invention relate to methods comprising administering to a subject in need thereof a therapeutically effective amount of a double stranded ribonucleic acid (dsRNA) comprising a sense strand and an antisense strand wherein the antisense strand is complementary to at least 12 contiguous nucleotides of a sequence selected from the sequences within Tables 2, 5, 6, 9, 11, 12, 13, 14, 15, 16, 17 and 23, and wherein the dsRNA is an rxRNAori.

Further aspects of the invention relate to methods comprising administering to a subject in need thereof a therapeutically effective amount of a double stranded ribonucleic acid (dsRNA) comprising a sense strand and an antisense strand wherein the sense strand and/or the antisense strand comprises at least 12 contiguous nucleotides of a sequence selected from the sequences within Tables 1-27, and wherein the dsRNA is an rxRNAori.

In some embodiments, the method is a method for treating compromised skin. In some embodiments, the method is a method for treating or preventing a fibrotic disorder.

In some embodiments, the dsRNA is administered via intradermal injection. In some embodiments, the dsRNA is administered locally to the skin. In some embodiments, two or more nucleic acid molecules are administered simultaneously or sequentially.

In some embodiments, one or more of the dsRNAs is hydrophobically modified. In certain embodiments, one or more of the dsRNAs is linked to a hydrophobic conjugate.

In some embodiments, the dsRNA is directed against CTGF. In certain embodiments, the antisense strand of the dsRNA is complementary to at least 12 contiguous nucleotides of a sequence selected from the sequences within Tables 11, 12 and 15. In some embodiments, the sense strand and/or the antisense strand comprises at least 12 contiguous nucleotides of a sequence selected from the sequences within Tables 10, 11, 12, 15, 20 and 24.

In some embodiments, the sense strand comprises at least 12 contiguous nucleotides of a sequence selected from the group consisting of: SEQ ID NOs: 2463, 3429, 2443, 3445, 2459, 3493, 2465 and 3469. In certain embodiments, the antisense strand comprises at least 12 contiguous nucleotides of a sequence selected from the group consisting of: 2464, 3430, 4203, 3446, 2460, 3494, 2466 and 3470.

In certain embodiments, the sense strand comprises SEQ ID NO:2463 and the antisense strand comprises SEQ ID NO:2464. In certain embodiments, the sense strand comprises SEQ ID NO:3429 and the antisense strand comprises SEQ ID NO:3430.

In certain embodiments, the sense strand comprises SEQ ID NO:2443 and the antisense strand comprises SEQ ID NO:4203. In certain embodiments, the sense strand comprises SEQ ID NO:3445 and the antisense strand comprises SEQ ID NO:3446.

In certain embodiments, the sense strand comprises SEQ ID NO:2459 and the antisense strand comprises SEQ ID NO:2460. In certain embodiments, the sense strand comprises SEQ ID NO:3493 and the antisense strand comprises SEQ ID NO:3494.

In certain embodiments, the sense strand comprises SEQ ID NO:2465 and the antisense strand comprises SEQ ID NO:2466. In certain embodiments, the sense strand comprises SEQ ID NO:3469 and the antisense strand comprises SEQ ID NO:3470.

In some embodiments, the sense strand comprises at least 12 contiguous nucleotides of a sequence selected from the group consisting of: SEQ ID NOs: 1835, 1847, 1848 and 1849. In some embodiments, the sense strand comprises a sequence selected from the group consisting of: SEQ ID NOs: 1835, 1847, 1848 and 1849.

Aspects of the invention relate to treating or preventing a fibrotic disorder. In some embodiments, the fibrotic disorder is selected from the group consisting of pulmonary fibrosis, liver cirrhosis, scleroderma and glomerulonephritis, lung fibrosis, liver fibrosis, skin fibrosis, muscle fibrosis, radiation fibrosis, kidney fibrosis, proliferative vitreoretinopathy, restenosis and uterine fibrosis, and trabeculectomy failure due to scarring.

In some embodiments, the dsRNA are administered via intradermal injection, while in other embodiments, the one or more dsRNA are administered subcutaneously or epicutaneously.

The one or more dsRNA can be administered prior to, during and/or after a medical procedure. In some embodiments, administration occurs within 8 days prior to or within 8 days after the medical procedure. In some embodiments, the medical procedure is surgery. In certain embodiments, the surgery is elective. In some embodiments, the surgery comprises epithelial grafting or skin grafting. In some embodiments, the one or more double stranded nucleic acid molecules are administered to a graft donor site and/or a graft recipient site.

Aspects of the invention relate to methods for administering one or more dsRNA prior to, during and/or after an injury. In some embodiments, the subject has a wound such as a chronic wound. In certain embodiments, the wound is a result of elective surgery. The wound can be external or internal. In some embodiments, the dsRNA is administered after burn injury.

Methods described herein include methods for promoting wound healing and methods for preventing scarring.

In some embodiments, one or more of the dsRNA administered to a subject is directed against a gene selected from the group consisting of TGFB1, TGFB2, hTGFB1, hTGFB2, PTGS2, SPP1, hSPP1, CTGF or hCTGF. In some embodiments, the one or more dsRNA are administered on the skin of the subject. In certain embodiments, the one or more dsRNA molecules are in the form of a cream or ointment. In some embodiments, two or more or three or more nucleic acids are administered. Two or more nucleic acid molecules can be administered simultaneously or sequentially.

Aspects of the invention related to nucleic acids that are optimized. In some embodiments, one or more double stranded nucleic acid molecules are hydrophobically modified. In certain embodiments, the one or more double stranded nucleic acid molecules are linked to a hydrophobic conjugate or multiple hydrophobic conjugates. In some embodiments, the one or more double stranded nucleic acid molecule are linked to a lipophilic group. In certain embodiments, the lipophilic group is linked to the passenger strand of the one or more double stranded nucleic acid molecules. In some embodiment, the one or more double stranded nucleic acid molecules are linked to cholesterol, a long chain alkyl cholesterol analog, vitamin A or vitamin E. In some embodiments, the one or more double stranded nucleic acid molecules is attached to chloroformate.

Aspects of the invention related to nucleic acids that are optimized through modifications. In some embodiments, the one or more double stranded nucleic acid molecules includes at least one 2' O methyl or 2' fluoro modification and/or at least one 5 methyl C or U modification. In some embodiments, the one or more double stranded nucleic acid molecules has a guide strand of 16-28 nucleotides in length. In certain embodiments, at least 40% of the nucleotides of the one or more double stranded nucleic acid molecules are modified. Double stranded nucleic acid molecules described herein can also be attached to linkers. In some embodiments, the linker is protonatable.

Aspects of the invention relate to double stranded nucleic acid molecules that contain at least two single stranded regions. In some embodiments, the single stranded regions contain phosphorothioate modifications. In certain embodiments, the single stranded regions are located at the 3' end of the guide strand and the 5' end of the passenger strand.

Aspects of the invention relate to methods for delivering a nucleic acid to a subject, involving administering to a subject within 8 days prior to a medical procedure a therapeutically effective amount for treating compromised skin of one or more sd-rxRNAs.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 2 presents schematics depicting an experimental approach to visualizing tissue after intradermal injection.

FIG. 3 demonstrates silencing of MAP4K4 following intradermal injection of sd-rxRNA targeting MAP4K4.

FIG. 39 provides a summary of compounds that are active in vivo.

FIG. 45 demonstrates absolute luminescence of CTGF L4 sd-rxRNAs.

FIG. 61 demonstrates that chemically optimized hTGFB1 L1 sd-rxRNAs are active.

DETAILED DESCRIPTION

Figure 1:
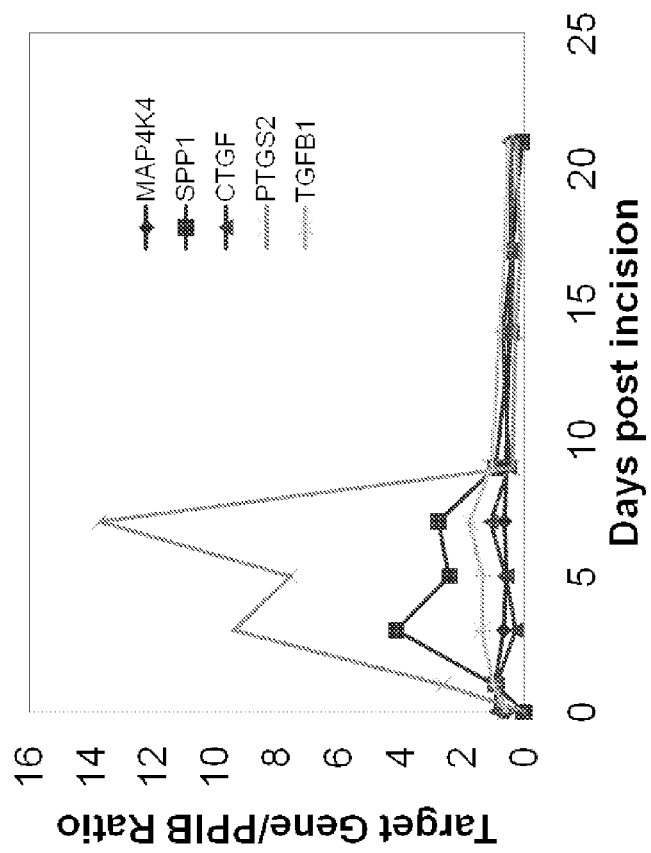
FIG. 1 demonstrates the expression profiles for non-limiting examples of target genes including MAP4K4, SPP1, CTGF, PTGS2 and TGFB1. As expected, target gene expression is elevated early and returns to normal by day 10.

Aspects of the invention relate to methods and compositions involved in gene silencing. The invention is based at least in part on the surprising discovery that administration of sd-rxRNA molecules to the skin, such as through intradermal injection or subcutaneous administration, results in efficient silencing of gene expression in the skin. Highly potent sd-rxRNA molecules that target genes including SPP1, CTGF, PTGS2, TGFB1 and TGFB2 were also identified herein through cell-based screening. sd-rxRNAs represent a new class of therapeutic RNAi molecules with significant potential in treatment of compromised skin.

sd-rxRNA Molecules

Aspects of the invention relate to sd-rxRNA molecules. As used herein, an "sd-rxRNA" or an "sd-rxRNA molecule" refers to a self-delivering RNA molecule such as those described in, and incorporated by reference from, PCT Publication No. WO2010/033247 (Application No. PCT/US2009/005247), filed on Sep. 22, 2009, and entitled "REDUCED SIZE SELF-DELIVERING RNAI COMPOUNDS," and PCT application PCT/US2009/005246, filed on Sep. 22, 2009, and entitled "RNA INTERFERENCE IN SKIN INDICATIONS." Briefly, an sd-rxRNA, (also referred to as an sd-rxRNA$^{nano}$) is an isolated asymmetric double stranded nucleic acid molecule comprising a guide strand, with a minimal length of 16 nucleotides, and a passenger strand of 8-18 nucleotides in length, wherein the double stranded nucleic acid molecule has a double stranded region and a single stranded region, the single stranded region having 4-12 nucleotides in length and having at least three nucleotide backbone modifications. In preferred embodiments, the double stranded nucleic acid molecule has one end that is blunt or includes a one or two nucleotide overhang. sd-rxRNA molecules can be optimized through chemical modification, and in some instances through attachment of hydrophobic conjugates.

In some embodiments, an sd-rxRNA comprises an isolated double stranded nucleic acid molecule comprising a guide strand and a passenger strand, wherein the region of the molecule that is double stranded is from 8-15 nucleotides long, wherein the guide strand contains a single stranded region that is 4-12 nucleotides long, wherein the single stranded region of the guide strand contains 3, 4, 5, 6, 7, 8, 9, 10, 11 or 12 phosphorothioate modifications, and wherein at least 40% of the nucleotides of the double stranded nucleic acid are modified.

The polynucleotides of the invention are referred to herein as isolated double stranded or duplex nucleic acids, oligonucleotides or polynucleotides, nano molecules, nano RNA, sd-rxRNA$^{nano}$, sd-rxRNA or RNA molecules of the invention.

sd-rxRNAs are much more effectively taken up by cells compared to conventional siRNAs. These molecules are highly efficient in silencing of target gene expression and offer significant advantages over previously described RNAi molecules including high activity in the presence of serum, efficient self delivery, compatibility with a wide variety of linkers, and reduced presence or complete absence of chemical modifications that are associated with toxicity.

In contrast to single-stranded polynucleotides, duplex polynucleotides have traditionally been difficult to deliver to a cell as they have rigid structures and a large number of negative charges which makes membrane transfer difficult. sd-rxRNAs however, although partially double-stranded, are recognized in vivo as single-stranded and, as such, are capable of efficiently being delivered across cell membranes. As a result the polynucleotides of the invention are capable in many instances of self delivery. Thus, the polynucleotides of the invention may be formulated in a manner similar to conventional RNAi agents or they may be delivered to the cell or subject alone (or with non-delivery type carriers) and allowed to self deliver. In one embodiment of the present invention, self delivering asymmetric double-stranded RNA molecules are provided in which one portion of the molecule resembles a conventional RNA duplex and a second portion of the molecule is single stranded.

The oligonucleotides of the invention in some aspects have a combination of asymmetric structures including a double stranded region and a single stranded region of 5 nucleotides or longer, specific chemical modification patterns and are conjugated to lipophilic or hydrophobic molecules. This class of RNAi like compounds have superior efficacy in vitro and in vivo. It is believed that the reduction in the size of the rigid duplex region in combination with phosphorothioate modifications applied to a single stranded region contribute to the observed superior efficacy.

The invention is based at least in part on the surprising discovery that sd-rxRNA molecules are delivered efficiently in vivo to the skin through a variety of methods including intradermal injection and subcutaneous administration. Furthermore, sd-rxRNA molecules are efficient in mediating gene silencing in the region of the skin where they are targeted.

Aspects of the invention relate to the use of cell-based screening to identify potent sd-rxRNA molecules. Described herein is the identification of potent sd-rxRNA molecules that target a subset of genes including SPP1, CTFG, PTGS2, TGFB1 and TGFB2. In some embodiments, a target gene is selected and an algorithm is applied to identify optimal target sequences within that gene (Example 2). For example, many sequences can be selected for one gene. In some instances, the sequences that are identified are generated as RNAi compounds for a first round of testing. For example, the RNAi compounds based on the optimal predicted sequences can initially be generated as rxRNAori ("ori") sequences for the first round of screening. After identifying potent RNAi compounds, these can be generated as sd-rxRNA molecules.

dsRNA formulated according to the invention also includes rxRNAori. rxRNAori refers to a class of RNA molecules described in and incorporated by reference from PCT Publication No. WO2009/102427 (Application No. PCT/US2009/000852), filed on Feb. 11, 2009, and entitled, "MODIFIED RNAI POLYNUCLEOTIDES AND USES THEREOF."

In some embodiments, an rxRNAori molecule comprises a double-stranded RNA (dsRNA) construct of 12-35 nucleotides in length, for inhibiting expression of a target gene, comprising: a sense strand having a 5'-end and a 3'-end, wherein the sense strand is highly modified with 2'-modified ribose sugars, and wherein 3-6 nucleotides in the central portion of the sense strand are not modified with 2'-modified ribose sugars and, an antisense strand having a 5'-end and a 3'-end, which hybridizes to the sense strand and to mRNA of the target gene, wherein the dsRNA inhibits expression of the target gene in a sequence-dependent manner.

rxRNAori can contain any of the modifications described herein. In some embodiments, at least 30% of the nucleotides in the rxRNAori are modified. For example, at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% of the nucleotides in the rxRNAori are modified. In some embodiments, 100% of the nucleotides in the sd-rxRNA are modified. In some embodiments, only the passenger strand of the rxRNAori contains modifications.

In some embodiments, the RNAi compounds of the invention comprise an asymmetric compound comprising a duplex region (required for efficient RISC entry of 8-15 bases long) and single stranded region of 4-12 nucleotides long; with a 13 or 14 nucleotide duplex. A 6 or 7 nucleotide single stranded region is preferred in some embodiments. The single stranded region of the new RNAi compounds also comprises 2-12 phosphorothioate internucleotide linkages (referred to as phosphorothioate modifications). 6-8 phosphorothioate internucleotide linkages are preferred in some embodiments. Additionally, the RNAi compounds of the invention also include a unique chemical modification pattern, which provides stability and is compatible with RISC entry. The combination of these elements has resulted in unexpected properties which are highly useful for delivery of RNAi reagents in vitro and in vivo.

The chemical modification pattern, which provides stability and is compatible with RISC entry includes modifications to the sense, or passenger, strand as well as the antisense, or guide, strand. For instance the passenger strand can be modified with any chemical entities which confirm stability and do not interfere with activity. Such modifications include 2' ribo modifications (O-methyl, 2' F, 2 deoxy and others) and backbone modification like phosphorothioate modifications. A preferred chemical modification pattern in the passenger strand includes Omethyl modification of C and U nucleotides within the passenger strand or alternatively the passenger strand may be completely Omethyl modified.

The guide strand, for example, may also be modified by any chemical modification which confirms stability without interfering with RISC entry. A preferred chemical modification pattern in the guide strand includes the majority of C and U nucleotides being 2' F modified and the 5' end being phosphorylated. Another preferred chemical modification pattern in the guide strand includes 2' Omethyl modification of position 1 and C/U in positions 11-18 and 5' end chemical phosphorylation. Yet another preferred chemical modification pattern in the guide strand includes 2' Omethyl modification of position 1 and C/U in positions 11-18 and 5' end chemical phosphorylation and 2'F modification of C/U in positions 2-10. In some embodiments the passenger strand and/or the guide strand contains at least one 5-methyl C or U modifications.

In some embodiments, at least 30% of the nucleotides in the sd-rxRNA are modified. For example, at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% of the nucleotides in the sd-rxRNA are modified. In some embodiments, 100% of the nucleotides in the sd-rxRNA are modified.

The above-described chemical modification patterns of the oligonucleotides of the invention are well tolerated and actually improved efficacy of asymmetric RNAi compounds.

It was also demonstrated experimentally herein that the combination of modifications to RNAi when used together in a polynucleotide results in the achievement of optimal efficacy in passive uptake of the RNAi. Elimination of any of the described components (Guide strand stabilization, phosphorothioate stretch, sense strand stabilization and hydrophobic conjugate) or increase in size in some instances results in sub-optimal efficacy and in some instances complete lost of efficacy. The combination of elements results in development of a compound, which is fully active following passive delivery to cells such as HeLa cells.

The data in the Examples presented below demonstrates high efficacy of the oligonucleotides of the invention both in vitro in variety of cell types and in vivo upon local and systemic administration.

The sd-rxRNA can be further improved in some instances by improving the hydrophobicity of compounds using of novel types of chemistries. For example one chemistry is related to use of hydrophobic base modifications. Any base in any position might be modified, as long as modification results in an increase of the partition coefficient of the base. The preferred locations for modification chemistries are positions 4 and 5 of the pyrimidines. The major advantage of these positions is (a) ease of synthesis and (b) lack of interference with base-pairing and A form helix formation, which are essential for RISC complex loading and target recognition. A version of sd-rxRNA compounds where multiple deoxy Uridines are present without interfering with overall compound efficacy was used. In addition major improvement in tissue distribution and cellular uptake might be obtained by optimizing the structure of the hydrophobic conjugate. In some of the preferred embodiment the structure of sterol is modified to alter (increase/decrease) C17 attached chain. This type of modification results in significant increase in cellular uptake and improvement of tissue uptake prosperities in vivo.

Aspects of the invention relate to double-stranded ribonucleic acid molecules (dsRNA) such as sd-rxRNA and rxRNAori. dsRNA associated with the invention can comprise a sense strand and an antisense strand wherein the antisense strand is complementary to at least 12 contiguous nucleotides of a sequence selected from the sequences within Tables 2, 5, 6, 9, 11, 12, 13, 14, 15, 16, 17 and 23. For example, the antisense strand can be complementary to at least 12, 13, 14, 15, 16, 17, 18, 19, 20, 21, 22, 23, or 24 contiguous nucleotides, or can be complementary to 25 nucleotides of a sequence selected from the sequences within Tables 2, 5, 6, 9, 11, 12, 13, 14, 15, 16, 17 and 23.

dsRNA associated with the invention can comprise a sense strand and an antisense strand wherein the sense strand and/or the antisense strand comprises at least 12 contiguous nucleotides of a sequence selected from the sequences within Tables 1-27. For example, the sense strand and/or the antisense strand can comprise at least 12, 13, 14, 15, 16, 17, 18, 19, 20, 21, 22, 23, or 24 contiguous nucleotides, or can comprise 25 nucleotides of a sequence selected from the sequences within Tables 1-27.

Aspects of the invention relate to dsRNA directed against CTGF. For example, the antisense strand of a dsRNA directed against CTGF can be complementary to at least 12 contiguous nucleotides of a sequence selected from the sequences within Tables 11, 12 and 15. The sense strand and/or the antisense strand of a dsRNA directed against CTGF can comprises at least 12 contiguous nucleotides of a sequence selected from the sequences within Tables 10, 11, 12, 15, 20 and 24.

In some embodiments, the sense strand comprises at least 12 contiguous nucleotides of a sequence selected from the group consisting of: SEQ ID NOs: 2463, 3429, 2443, 3445, 2459, 3493, 2465 and 3469. In certain embodiments, the sense strand comprises or consists of a sequence selected from the group consisting of: SEQ ID NOs: 2463, 3429, 2443, 3445, 2459, 3493, 2465 and 3469.

In some embodiments, the antisense strand comprises at least 12 contiguous nucleotides of a sequence selected from the group consisting of: 2464, 3430, 4203, 3446, 2460, 3494, 2466 and 3470. In certain embodiments, the antisense strand comprises or consists of a sequence selected from the group consisting of: 2464, 3430, 4203, 3446, 2460, 3494, 2466 and 3470.

In a preferred embodiment, the sense strand comprises SEQ ID NO:2463 (GCACCUUUCUAGA) and the antisense strand comprises SEQ ID NO:2464 (UCUAGAAAGGUG-CAAACAU). The sequences of SEQ ID NO:2463 and SEQ ID NO:2464 can be modified in a variety of ways according to modifications described herein. A preferred modification pattern for SEQ ID NO:2463 is depicted by SEQ ID NO:3429 (G.mC. A.mC.mC.mU.mU.mU.mC.mU. A*mG*mA.TEG-Ch1). A preferred modification pattern for SEQ ID NO:2464 is depicted by SEQ ID NO:3430 (P.mU.fC.fU. A. G.mA. A.mA. G. G.fU. G.mC* A* A* A*mC* A* U). An sd-rxRNA consisting of SEQ ID NO:3429 and SEQ ID NO:3430 is also referred to as RXi-109.

In another preferred embodiment, the sense strand comprises SEQ ID NO:2443 (UUGCACCUUUCUAA) and the antisense strand comprises SEQ ID NO:4203 (UUA-GAAAGGUGCAAACAAGG). The sequences of SEQ ID NO:2443 and SEQ ID NO:4203 can be modified in a variety of ways according to modifications described herein. A preferred modification pattern for SEQ ID NO:2443 is depicted by SEQ ID NO:3445 (mU.mU. G.mC. A.mC.mC.mU.mU.mU.mC.mU*mA*mA.TEG-Ch1). A preferred modification pattern for SEQ ID NO:4203 is depicted by SEQ ID NO:3446 (P.mU.fU. A. G. A.mA. A. G. G.fU. G.fC.mA.mA*mA*fC*mA*mA*mG* G.).

In another preferred embodiment, the sense strand comprises SEQ ID NO:2459 (GUGACCAAAAGUA) and the antisense strand comprises SEQ ID NO:2460 (UACU-UUUGGUCACACUCUC). The sequences of SEQ ID NO:2459 and SEQ ID NO:2460 can be modified in a variety of ways according to modifications described herein. A preferred modification pattern for SEQ ID NO:2459 is depicted by SEQ ID NO:3493 (G.mU. G. A.mC.mC. A. A. A. A. G*mU*mA.TEG-Ch1). A preferred modification pattern for SEQ ID NO:2460 is depicted by SEQ ID NO:3494 (P.mU. A.fC.fU.fU.fU.fU. G. G.fU.mC. A.mC* A*mC*mU*mC*mU* C.).

In another preferred embodiment, the sense strand comprises SEQ ID NO:2465 (CCUUUCUAGUUGA) and the antisense strand comprises SEQ ID NO:2466 (UCAACUA-GAAAGGUGCAAA). The sequences of SEQ ID NO:2465 and SEQ ID NO:2466 can be modified in a variety of ways according to modifications described herein. A preferred modification pattern for SEQ ID NO:2465 is depicted by SEQ ID NO:3469 (mC.mC.mU.mU.mU.mC.mU. A. G.mU.mU*mG*mA.TEG-Ch1). A preferred modification pattern for SEQ ID NO:2466 is depicted by SEQ ID NO:3470 (P.mU.fC. A. A.fC.fU. A. G. A.mA. A. G. G*fU*mG*fC*mA*mA* A.).

A preferred embodiment of an rxRNAori directed against CTGF can comprise at least 12 contiguous nucleotides of a sequence selected from the group consisting of: SEQ ID NOs:1835, 1847, 1848 and 1849. In some embodiments, the sense strand of the rxRNAori comprises or consists of SEQ ID NOs:1835, 1847, 1848 or 1849.

Aspects of the invention relate to compositions comprising dsRNA such as sd-rxRNA and rxRNAori. In some embodiments compositions comprise two or more dsRNA that are directed against different genes.

This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Thus, aspects of the invention relate to isolated double stranded nucleic acid molecules comprising a guide (antisense) strand and a passenger (sense) strand. As used herein, the term "double-stranded" refers to one or more nucleic acid molecules in which at least a portion of the nucleomonomers are complementary and hydrogen bond to form a double-stranded region. In some embodiments, the length of the guide strand ranges from 16-29 nucleotides long. In certain embodiments, the guide strand is 16, 17, 18, 19, 20, 21, 22, 23, 24, 25, 26, 27, 28, or 29 nucleotides long. The guide strand has complementarity to a target gene. Complementarity between the guide strand and the target gene may exist over any portion of the guide strand. Complementarity as used herein may be perfect complementarity or less than perfect complementarity as long as the guide strand is sufficiently complementary to the target that it mediates RNAi. In some embodiments complementarity refers to less than 25%, 20%, 15%, 10%, 5%, 4%, 3%, 2%, or 1% mismatch between the guide strand and the target. Perfect complementarity refers to 100% complementarity. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Moreover, not all positions of a siRNA contribute equally to target recognition. Mismatches in the center of the siRNA are most critical and essentially abolish target RNA cleavage. Mismatches upstream of the center or upstream of the cleavage site referencing the antisense strand are tolerated but significantly reduce target RNA cleavage. Mismatches downstream of the center or cleavage site referencing the antisense strand, preferably located near the 3' end of the antisense strand, e.g. 1, 2, 3, 4, 5 or 6 nucleotides from the 3' end of the antisense strand, are tolerated and reduce target RNA cleavage only slightly.

While not wishing to be bound by any particular theory, in some embodiments, the guide strand is at least 16 nucleotides in length and anchors the Argonaute protein in RISC. In some embodiments, when the guide strand loads into RISC it has a defined seed region and target mRNA cleavage takes place across from position 10-11 of the guide strand. In some embodiments, the 5' end of the guide strand is or is able to be phosphorylated. The nucleic acid molecules described herein may be referred to as minimum trigger RNA.

In some embodiments, the length of the passenger strand ranges from 8-15 nucleotides long. In certain embodiments, the passenger strand is 8, 9, 10, 11, 12, 13, 14 or 15 nucleotides long. The passenger strand has complementarity to the guide strand. Complementarity between the passenger strand and the guide strand can exist over any portion of the passenger or guide strand. In some embodiments, there is 100% complementarity between the guide and passenger strands within the double stranded region of the molecule.

Aspects of the invention relate to double stranded nucleic acid molecules with minimal double stranded regions. In some embodiments the region of the molecule that is double stranded ranges from 8-15 nucleotides long. In certain embodiments, the region of the molecule that is double stranded is 8, 9, 10, 11, 12, 13, 14 or 15 nucleotides long. In certain embodiments the double stranded region is 13 or 14 nucleotides long. There can be 100% complementarity between the guide and passenger strands, or there may be one or more mismatches between the guide and passenger strands. In some embodiments, on one end of the double stranded molecule, the molecule is either blunt-ended or has a one-nucleotide overhang. The single stranded region of the molecule is in some embodiments between 4-12 nucleotides long. For example the single stranded region can be 4, 5, 6, 7, 8, 9, 10, 11 or 12 nucleotides long. However, in certain embodiments, the single stranded region can also be less than 4 or greater than 12 nucleotides long. In certain embodiments, the single stranded region is 6 nucleotides long.

RNAi constructs associated with the invention can have a thermodynamic stability (ΔG) of less than −13 kkal/mol. In some embodiments, the thermodynamic stability (ΔG) is less than −20 kkal/mol. In some embodiments there is a loss of efficacy when (ΔG) goes below −21 kkal/mol. In some embodiments a (ΔG) value higher than −13 kkal/mol is compatible with aspects of the invention. Without wishing to be bound by any theory, in some embodiments a molecule with a relatively higher (ΔG) value may become active at a relatively higher concentration, while a molecule with a relatively lower (ΔG) value may become active at a relatively lower concentration. In some embodiments, the (ΔG) value may be higher than −9 kkcal/mol. The gene silencing effects mediated by the RNAi constructs associated with the invention, containing minimal double stranded regions, are unexpected because molecules of almost identical design but lower thermodynamic stability have been demonstrated to be inactive (Rana et al. 2004).

Without wishing to be bound by any theory, results described herein suggest that a stretch of 8-10 bp of dsRNA or dsDNA will be structurally recognized by protein components of RISC or co-factors of RISC. Additionally, there is a free energy requirement for the triggering compound that it may be either sensed by the protein components and/or stable enough to interact with such components so that it may be loaded into the Argonaute protein. If optimal thermodynamics are present and there is a double stranded portion that is preferably at least 8 nucleotides then the duplex will be recognized and loaded into the RNAi machinery.

In some embodiments, thermodynamic stability is increased through the use of LNA bases. In some embodiments, additional chemical modifications are introduced. Several non-limiting examples of chemical modifications include: 5' Phosphate, 2'-O-methyl, 2'-O-ethyl, 2'-fluoro, ribothymidine, C-5 propynyl-dC (pdC) and C-5 propynyl-dU (pdU); C-5 propynyl-C (pC) and C-5 propynyl-U (pU); 5-methyl C, 5-methyl U, 5-methyl dC, 5-methyl dU methoxy, (2,6-diaminopurine), 5'-Dimethoxytrityl-N4-ethyl-2'-deoxy-Cytidine and MGB (minor groove binder). It should be appreciated that more than one chemical modification can be combined within the same molecule.

Molecules associated with the invention are optimized for increased potency and/or reduced toxicity. For example, nucleotide length of the guide and/or passenger strand, and/or the number of phosphorothioate modifications in the guide and/or passenger strand, can in some aspects influence potency of the RNA molecule, while replacing 2'-fluoro (2'F) modifications with 2'-O-methyl (2'OMe) modifications can in some aspects influence toxicity of the molecule. Specifically, reduction in 2'F content of a molecule is predicted to reduce toxicity of the molecule. The Examples section presents molecules in which 2'F modifications have been eliminated, offering an advantage over previously described RNAi compounds due to a predicted reduction in toxicity. Furthermore, the number of phosphorothioate modifications in an RNA molecule can influence the uptake of the molecule into a cell, for example the efficiency of passive uptake of the molecule into a cell. Preferred embodiments of molecules described herein have no 2'F modification and yet are characterized by equal efficacy in cellular uptake and tissue penetration. Such molecules represent a significant improvement over prior art, such as molecules described by Accell and Wolfrum, which are heavily modified with extensive use of 2'F.

In some embodiments, a guide strand is approximately 18-19 nucleotides in length and has approximately 2-14 phosphate modifications. For example, a guide strand can contain 2, 3, 4, 5, 6, 7, 8, 9, 10, 11, 12, 13, 14 or more than 14 nucleotides that are phosphate-modified. The guide strand may contain one or more modifications that confer increased stability without interfering with RISC entry. The phosphate modified nucleotides, such as phosphorothioate modified nucleotides, can be at the 3' end, 5' end or spread throughout the guide strand. In some embodiments, the 3' terminal 10 nucleotides of the guide strand contains 1, 2, 3, 4, 5, 6, 7, 8, 9 or 10 phosphorothioate modified nucleotides. The guide strand can also contain 2'F and/or 2'OMe modifications, which can be located throughout the molecule. In some embodiments, the nucleotide in position one of the guide strand (the nucleotide in the most 5' position of the guide strand) is 2'OMe modified and/or phosphorylated. C and U nucleotides within the guide strand can be 2'F modified. For example, C and U nucleotides in positions 2-10 of a 19 nt guide strand (or corresponding positions in a guide strand of a different length) can be 2'F modified. C and U nucleotides within the guide strand can also be 2'OMe modified. For example, C and U nucleotides in positions 11-18 of a 19 nt guide strand (or corresponding positions in a guide strand of a different length) can be 2'OMe modified. In some embodiments, the nucleotide at the most 3' end of the guide strand is unmodified. In certain embodiments, the majority of Cs and Us within the guide strand are 2'F modified and the 5' end of the guide strand is phosphorylated. In other embodiments, position 1 and the Cs or Us in positions 11-18 are 2'OMe modified and the 5' end of the guide strand is phosphorylated. In other embodiments, position 1 and the Cs or Us in positions 11-18 are 2'OMe modified, the 5' end of the guide strand is phosphorylated, and the Cs or Us in position 2-10 are 2'F modified.

In some aspects, an optimal passenger strand is approximately 11-14 nucleotides in length. The passenger strand may contain modifications that confer increased stability. One or more nucleotides in the passenger strand can be 2'OMe modified. In some embodiments, one or more of the C and/or U nucleotides in the passenger strand is 2'OMe modified, or all of the C and U nucleotides in the passenger strand are 2'OMe modified. In certain embodiments, all of the nucleotides in the passenger strand are 2'OMe modified. One or more of the nucleotides on the passenger strand can also be phosphate-modified such as phosphorothioate modified. The passenger strand can also contain 2' ribo, 2'F and 2 deoxy modifications or any combination of the above. As demonstrated in the Examples, chemical modification patterns on both the guide and passenger strand are well tolerated and a combination of chemical modifications is shown herein to lead to increased efficacy and self-delivery of RNA molecules.

Aspects of the invention relate to RNAi constructs that have extended single-stranded regions relative to double stranded regions, as compared to molecules that have been used previously for RNAi. The single stranded region of the molecules may be modified to promote cellular uptake or gene silencing. In some embodiments, phosphorothioate modification of the single stranded region influences cellular uptake and/or gene silencing. The region of the guide strand that is phosphorothioate modified can include nucleotides within both the single stranded and double stranded regions of the molecule. In some embodiments, the single stranded region includes 2-12 phosphorothioate modifications. For example, the single stranded region can include 2, 3, 4, 5, 6, 7, 8, 9, 10, 11, or 12 phosphorothioate modifications. In some instances, the single stranded region contains 6-8 phosphorothioate modifications.

Molecules associated with the invention are also optimized for cellular uptake. In RNA molecules described herein, the guide and/or passenger strands can be attached to a conjugate.

In certain embodiments the conjugate is hydrophobic. The hydrophobic conjugate can be a small molecule with a partition coefficient that is higher than 10. The conjugate can be a sterol-type molecule such as cholesterol, or a molecule with an increased length polycarbon chain attached to C17, and the presence of a conjugate can influence the ability of an RNA molecule to be taken into a cell with or without a lipid transfection reagent. The conjugate can be attached to the passenger or guide strand through a hydrophobic linker. In some embodiments, a hydrophobic linker is 5-12C in length, and/or is hydroxypyrrolidine-based. In some embodiments, a hydrophobic conjugate is attached to the passenger strand and the CU residues of either the passenger and/or guide strand are modified. In some embodiments, at least 50%, 55%, 60%, 65%, 70%, 75%, 80%, 85%, 90% or 95% of the CU residues on the passenger strand and/or the guide strand are modified. In some aspects, molecules associated with the invention are self-delivering (sd). As used herein, "self-delivery" refers to the ability of a molecule to be delivered into a cell without the need for an additional delivery vehicle such as a transfection reagent.

Aspects of the invention relate to selecting molecules for use in RNAi. Molecules that have a double stranded region of 8-15 nucleotides can be selected for use in RNAi. In some embodiments, molecules are selected based on their thermodynamic stability ($\Delta G$). In some embodiments, molecules will be selected that have a ($\Delta G$) of less than −13 kkal/mol. For example, the ($\Delta G$) value may be −13, −14, −15, −16, −17, −18, −19, −21, −22 or less than −22 kkal/mol. In other embodiments, the ($\Delta G$) value may be higher than −13 kkal/mol. For example, the ($\Delta G$) value may be −12, −11, −10, −9, −8, −7 or more than −7 kkal/mol. It should be appreciated that $\Delta G$ can be calculated using any method known in the art. In some embodiments $\Delta G$ is calculated using Mfold, available through the Mfold internet site (http://mfold.bioinfo.rpi.edu/cgi-bin/rna-form1.cgi). Methods for calculating $\Delta G$ are described in, and are incorporated by reference from, the following references: Zuker, M. (2003) Nucleic Acids Res., 31(13):3406-15; Mathews, D. H., Sabina, J., Zuker, M. and Turner, D. H. (1999) J. Mol. Biol. 288:911-940; Mathews, D. H., Disney, M. D., Childs, J. L., Schroeder, S. J., Zuker, M., and Turner, D. H. (2004) Proc. Natl. Acad. Sci. 101:7287-7292; Duan, S., Mathews, D. H., and Turner, D. H. (2006) Biochemistry 45:9819-9832; Wuchty, S., Fontana, W., Hofacker, I. L., and Schuster, P. (1999) Biopolymers 49:145-165.

In certain embodiments, the polynucleotide contains 5'- and/or 3'-end overhangs. The number and/or sequence of nucleotides overhang on one end of the polynucleotide may be the same or different from the other end of the polynucleotide. In certain embodiments, one or more of the overhang nucleotides may contain chemical modification(s), such as phosphorothioate or 2'-OMe modification.

In certain embodiments, the polynucleotide is unmodified. In other embodiments, at least one nucleotide is modified. In further embodiments, the modification includes a 2'-H or 2'-modified ribose sugar at the 2nd nucleotide from the 5'-end of the guide sequence. The "2nd nucleotide" is defined as the second nucleotide from the 5'-end of the polynucleotide.

As used herein, "2'-modified ribose sugar" includes those ribose sugars that do not have a 2'-OH group. "2'-modified ribose sugar" does not include 2'-deoxyribose (found in unmodified canonical DNA nucleotides). For example, the 2'-modified ribose sugar may be 2'-O-alkyl nucleotides, 2'-deoxy-2'-fluoro nucleotides, 2'-deoxy nucleotides, or combination thereof.

In certain embodiments, the 2'-modified nucleotides are pyrimidine nucleotides (e.g., C/U). Examples of 2'-O-alkyl nucleotides include 2'-O-methyl nucleotides, or 2'-O-allyl nucleotides.

In certain embodiments, the sd-rxRNA polynucleotide of the invention with the above-referenced 5'-end modification exhibits significantly (e.g., at least about 25%, 30%, 35%, 40%, 45%, 50%, 55%, 60%, 65%, 70%, 75%, 80%, 85%, 90% or more) less "off-target" gene silencing when compared to similar constructs without the specified 5'-end modification, thus greatly improving the overall specificity of the RNAi reagent or therapeutics.

As used herein, "off-target" gene silencing refers to unintended gene silencing due to, for example, spurious sequence homology between the antisense (guide) sequence and the unintended target mRNA sequence.

According to this aspect of the invention, certain guide strand modifications further increase nuclease stability, and/or lower interferon induction, without significantly decreasing RNAi activity (or no decrease in RNAi activity at all).

In some embodiments, wherein the RNAi construct involves a hairpin, the 5'-stem sequence may comprise a 2'-modified ribose sugar, such as 2'-O-methyl modified nucleotide, at the $2^{nd}$ nucleotide on the 5'-end of the polynucleotide and, in some embodiments, no other modified nucleotides. The hairpin structure having such modification may have enhanced target specificity or reduced off-target silencing compared to a similar construct without the 2'-O-methyl modification at said position.

Certain combinations of specific 5'-stem sequence and 3'-stem sequence modifications may result in further unexpected advantages, as partly manifested by enhanced ability to inhibit target gene expression, enhanced serum stability, and/or increased target specificity, etc.

In certain embodiments, the guide strand comprises a 2'-O-methyl modified nucleotide at the $2^{nd}$ nucleotide on the 5'-end of the guide strand and no other modified nucleotides.

In other aspects, the sd-rxRNA structures of the present invention mediates sequence-dependent gene silencing by a microRNA mechanism. As used herein, the term "microRNA" ("miRNA"), also referred to in the art as "small temporal RNAs" ("stRNAs"), refers to a small (10-50 nucleotide) RNA which are genetically encoded (e.g., by viral, mammalian, or plant genomes) and are capable of directing or mediating RNA silencing. An "miRNA disorder" shall refer to a disease or disorder characterized by an aberrant expression or activity of an miRNA.

microRNAs are involved in down-regulating target genes in critical pathways, such as development and cancer, in mice, worms and mammals. Gene silencing through a microRNA mechanism is achieved by specific yet imperfect base-pairing of the miRNA and its target messenger RNA (mRNA). Various mechanisms may be used in microRNA-mediated down-regulation of target mRNA expression.

miRNAs are noncoding RNAs of approximately 22 nucleotides which can regulate gene expression at the post transcriptional or translational level during plant and animal development. One common feature of miRNAs is that they are all excised from an approximately 70 nucleotide precursor RNA stem-loop termed pre-miRNA, probably by Dicer, an RNase III-type enzyme, or a homolog thereof. Naturally-occurring miRNAs are expressed by endogenous genes in vivo and are processed from a hairpin or stem-loop precursor (pre-miRNA or pri-miRNAs) by Dicer or other RNAses. miRNAs can exist transiently in vivo as a double-stranded duplex but only one strand is taken up by the RISC complex to direct gene silencing.

In some embodiments a version of sd-rxRNA compounds, which are effective in cellular uptake and inhibiting of miRNA activity are described. Essentially the compounds are similar to RISC entering version but large strand chemical modification patterns are optimized in the way to block cleavage and act as an effective inhibitor of the RISC action. For example, the compound might be completely or mostly Omethyl modified with the PS content described previously. For these types of compounds the 5' phosphorilation is not necessary. The presence of double stranded region is preferred as it is promotes cellular uptake and efficient RISC loading.

Another pathway that uses small RNAs as sequence-specific regulators is the RNA interference (RNAi) pathway, which is an evolutionarily conserved response to the presence of double-stranded RNA (dsRNA) in the cell. The dsRNAs are cleaved into ~20-base pair (bp) duplexes of small-interfering RNAs (siRNAs) by Dicer. These small RNAs get assembled into multiprotein effector complexes called RNA-induced silencing complexes (RISCs). The siRNAs then guide the cleavage of target mRNAs with perfect complementarity.

Some aspects of biogenesis, protein complexes, and function are shared between the siRNA pathway and the miRNA pathway. The subject single-stranded polynucleotides may mimic the dsRNA in the siRNA mechanism, or the microRNA in the miRNA mechanism.

In certain embodiments, the modified RNAi constructs may have improved stability in serum and/or cerebral spinal fluid compared to an unmodified RNAi constructs having the same sequence.

In certain embodiments, the structure of the RNAi construct does not induce interferon response in primary cells, such as mammalian primary cells, including primary cells from human, mouse and other rodents, and other non-human mammals. In certain embodiments, the RNAi construct may also be used to inhibit expression of a target gene in an invertebrate organism.

To further increase the stability of the subject constructs in vivo, the 3'-end of the hairpin structure may be blocked by protective group(s). For example, protective groups such as inverted nucleotides, inverted abasic moieties, or amino-end modified nucleotides may be used. Inverted nucleotides may comprise an inverted deoxynucleotide. Inverted abasic moieties may comprise an inverted deoxyabasic moiety, such as a 3',3'-linked or 5',5'-linked deoxyabasic moiety.

The RNAi constructs of the invention are capable of inhibiting the synthesis of any target protein encoded by target gene(s). The invention includes methods to inhibit expression of a target gene either in a cell in vitro, or in vivo. As such, the RNAi constructs of the invention are useful for treating a patient with a disease characterized by the overexpression of a target gene.

The target gene can be endogenous or exogenous (e.g., introduced into a cell by a virus or using recombinant DNA technology) to a cell. Such methods may include introduction of RNA into a cell in an amount sufficient to inhibit expression of the target gene. By way of example, such an RNA molecule may have a guide strand that is complementary to the nucleotide sequence of the target gene, such that the composition inhibits expression of the target gene.

The invention also relates to vectors expressing the subject hairpin constructs, and cells comprising such vectors or the subject hairpin constructs. The cell may be a mammalian cell in vivo or in culture, such as a human cell.

The invention further relates to compositions comprising the subject RNAi constructs, and a pharmaceutically acceptable carrier or diluent.

Another aspect of the invention provides a method for inhibiting the expression of a target gene in a mammalian cell, comprising contacting the mammalian cell with any of the subject RNAi constructs.

The method may be carried out in vitro, ex vivo, or in vivo, in, for example, mammalian cells in culture, such as a human cell in culture.

The target cells (e.g., mammalian cell) may be contacted in the presence of a delivery reagent, such as a lipid (e.g., a cationic lipid) or a liposome.

Another aspect of the invention provides a method for inhibiting the expression of a target gene in a mammalian cell, comprising contacting the mammalian cell with a vector expressing the subject RNAi constructs.

In one aspect of the invention, a longer duplex polynucleotide is provided, including a first polynucleotide that ranges in size from about 16 to about 30 nucleotides; a second polynucleotide that ranges in size from about 26 to about 46 nucleotides, wherein the first polynucleotide (the antisense strand) is complementary to both the second polynucleotide (the sense strand) and a target gene, and wherein both polynucleotides form a duplex and wherein the first polynucleotide contains a single stranded region longer than 6 bases in length and is modified with alternative chemical modification pattern, and/or includes a conjugate moiety that facilitates cellular delivery. In this embodiment, between about 40% to about 90% of the nucleotides of the passenger strand between about 40% to about 90% of the nucleotides of the guide strand, and between about 40% to about 90% of the nucleotides of the single stranded region of the first polynucleotide are chemically modified nucleotides.

In an embodiment, the chemically modified nucleotide in the polynucleotide duplex may be any chemically modified nucleotide known in the art, such as those discussed in detail above. In a particular embodiment, the chemically modified nucleotide is selected from the group consisting of 2' F modified nucleotides, 2'-O-methyl modified and 2' deoxy nucleotides. In another particular embodiment, the chemically modified nucleotides results from "hydrophobic modifications" of the nucleotide base. In another particular embodiment, the chemically modified nucleotides are phosphorothioates. In an additional particular embodiment, chemically modified nucleotides are combination of phosphorothioates, 2'-O-methyl, 2' deoxy, hydrophobic modifications and phosphorothioates. As these groups of modifications refer to modification of the ribose ring, back bone and nucleotide, it is feasible that some modified nucleotides will carry a combination of all three modification types.

In another embodiment, the chemical modification is not the same across the various regions of the duplex. In a particular embodiment, the first polynucleotide (the passenger strand), has a large number of diverse chemical modifications in various positions. For this polynucleotide up to 90% of nucleotides might be chemically modified and/or have mismatches introduced. In another embodiment, chemical modifications of the first or second polynucleotide include, but not limited to, 5' position modification of Uridine and Cytosine (4-pyridyl, 2-pyridyl, indolyl, phenyl ($C_6H_5OH$); tryptophanyl (C8H6N)CH2CH(NH2)CO), isobutyl, butyl, aminobenzyl; phenyl; naphthyl, etc), where the chemical modification might alter base pairing capabilities of a nucleotide. For the guide strand an important feature of this aspect of the invention is the position of the chemical modification relative to the 5' end of the antisense and sequence. For example, chemical phosphorylation of the 5' end of the guide strand is usually beneficial for efficacy. O-methyl modifications in the seed region of the sense strand (position 2-7 relative to the 5' end) are not generally well tolerated, whereas 2'F and deoxy are well tolerated. The mid part of the guide strand and the 3' end of the guide strand are more permissive in a type of chemical modifications applied. Deoxy modifications are not tolerated at the 3' end of the guide strand.

A unique feature of this aspect of the invention involves the use of hydrophobic modification on the bases. In one embodiment, the hydrophobic modifications are preferably positioned near the 5' end of the guide strand, in other embodiments, they localized in the middle of the guides strand, in other embodiment they localized at the 3' end of the guide strand and yet in another embodiment they are distributed thought the whole length of the polynucleotide. The same type of patterns is applicable to the passenger strand of the duplex.

The other part of the molecule is a single stranded region. The single stranded region is expected to range from 6 to 40 nucleotides.

In one embodiment, the single stranded region of the first polynucleotide contains modifications selected from the group consisting of between 40% and 90% hydrophobic base modifications, between 40%-90% phosphorothioates, between 40%-90% modification of the ribose moiety, and any combination of the preceding.

Efficiency of guide strand (first polynucleotide) loading into the RISC complex might be altered for heavily modified polynucleotides, so in one embodiment, the duplex polynucleotide includes a mismatch between nucleotide 9, 11, 12, 13, or 14 on the guide strand (first polynucleotide) and the opposite nucleotide on the sense strand (second polynucleotide) to promote efficient guide strand loading.

More detailed aspects of the invention are described in the sections below.

Duplex Characteristics

Double-stranded oligonucleotides of the invention may be formed by two separate complementary nucleic acid strands. Duplex formation can occur either inside or outside the cell containing the target gene.

As used herein, the term "duplex" includes the region of the double-stranded nucleic acid molecule(s) that is (are) hydrogen bonded to a complementary sequence. Double-stranded oligonucleotides of the invention may comprise a nucleotide sequence that is sense to a target gene and a complementary sequence that is antisense to the target gene. The sense and antisense nucleotide sequences correspond to the target gene sequence, e.g., are identical or are sufficiently identical to effect target gene inhibition (e.g., are about at least about 98% identical, 96% identical, 94%, 90% identical, 85% identical, or 80% identical) to the target gene sequence.

In certain embodiments, the double-stranded oligonucleotide of the invention is double-stranded over its entire length, i.e., with no overhanging single-stranded sequence at either end of the molecule, i.e., is blunt-ended. In other embodiments, the individual nucleic acid molecules can be of different lengths. In other words, a double-stranded oligonucleotide of the invention is not double-stranded over its entire length. For instance, when two separate nucleic acid molecules are used, one of the molecules, e.g., the first molecule comprising an antisense sequence, can be longer than the second molecule hybridizing thereto (leaving a portion of the molecule single-stranded). Likewise, when a single nucleic acid molecule is used a portion of the molecule at either end can remain single-stranded.

In one embodiment, a double-stranded oligonucleotide of the invention contains mismatches and/or loops or bulges, but is double-stranded over at least about 70% of the length of the oligonucleotide. In another embodiment, a double-stranded oligonucleotide of the invention is double-stranded over at least about 80% of the length of the oligonucleotide. In another embodiment, a double-stranded oligonucleotide of the invention is double-stranded over at least about 90%-95% of the length of the oligonucleotide. In another embodiment, a double-stranded oligonucleotide of the invention is double-stranded over at least about 96%-98% of the length of the oligonucleotide. In certain embodiments, the double-stranded oligonucleotide of the invention contains at least or up to 1, 2, 3, 4, 5, 6, 7, 8, 9, 10, 11, 12, 13, 14, or 15 mismatches.

Modifications

The nucleotides of the invention may be modified at various locations, including the sugar moiety, the phosphodiester linkage, and/or the base.

In some embodiments, the base moiety of a nucleoside may be modified. For example, a pyrimidine base may be modified at the 2, 3, 4, 5, and/or 6 position of the pyrimidine ring. In some embodiments, the exocyclic amine of cytosine may be modified. A purine base may also be modified. For example, a purine base may be modified at the 1, 2, 3, 6, 7, or 8 position. In some embodiments, the exocyclic amine of adenine may be modified. In some cases, a nitrogen atom in a ring of a base moiety may be substituted with another atom, such as carbon. A modification to a base moiety may be any suitable modification. Examples of modifications are known to those of ordinary skill in the art. In some embodiments, the base modifications include alkylated purines or pyrimidines, acylated purines or pyrimidines, or other heterocycles.

In some embodiments, a pyrimidine may be modified at the 5 position. For example, the 5 position of a pyrimidine may be modified with an alkyl group, an alkynyl group, an alkenyl group, an acyl group, or substituted derivatives thereof. In other examples, the 5 position of a pyrimidine may be modified with a hydroxyl group or an alkoxyl group or substituted derivative thereof. Also, the $N^4$ position of a pyrimidine may be alkylated. In still further examples, the pyrimidine 5-6 bond may be saturated, a nitrogen atom within the pyrimidine ring may be substituted with a carbon atom, and/or the $O^2$ and $O^4$ atoms may be substituted with sulfur atoms. It should be understood that other modifications are possible as well.

In other examples, the $N^7$ position and/or $N^2$ and/or $N^3$ position of a purine may be modified with an alkyl group or substituted derivative thereof. In further examples, a third ring may be fused to the purine bicyclic ring system and/or a nitrogen atom within the purine ring system may be substituted with a carbon atom. It should be understood that other modifications are possible as well.

Non-limiting examples of pyrimidines modified at the 5 position are disclosed in U.S. Pat. Nos. 5,591,843, 7,205,297, 6,432,963, and 6,020,483; non-limiting examples of pyrimidines modified at the $N^4$ position are disclosed in U.S. Pat. No. 5,580,731; non-limiting examples of purines modified at the 8 position are disclosed in U.S. Pat. Nos. 6,355,787 and 5,580,972; non-limiting examples of purines modified at the $N^6$ position are disclosed in U.S. Pat. Nos. 4,853,386, 5,789,416, and 7,041,824; and non-limiting examples of purines modified at the 2 position are disclosed in U.S. Pat. Nos. 4,201,860 and 5,587,469, all of which are incorporated herein by reference.

Non-limiting examples of modified bases include $N^4,N^4$-ethanocytosine, 7-deazaxanthosine, 7-deazaguanosine, 8-oxo-$N^6$-methyladenine, 4-acetylcytosine, 5-(carboxyhydroxylmethyl)uracil, 5-fluorouracil, 5-bromouracil, 5-carboxymethylaminomethyl-2-thiouracil, 5-carboxymethylaminomethyl uracil, dihydrouracil, inosine, $N^6$-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, $N^6$-methyladenine, 7-methylguanine, 5-methylaminomethyl uracil, 5-methoxy aminomethyl-2-thiouracil, 5-methoxyuracil, 2-methylthio-$N^6$-isopentenyladenine, pseudouracil, 5-methyl-2-thiouracil, 2-thiouracil, 4-thiouracil, 5-methyluracil, 2-thiocytosine, and 2,6-diaminopurine. In some embodiments, the base moiety may be a heterocyclic base other than a purine or pyrimidine. The heterocyclic base may be optionally modified and/or substituted.

Sugar moieties include natural, unmodified sugars, e.g., monosaccharide (such as pentose, e.g., ribose, deoxyribose), modified sugars and sugar analogs. In general, possible modifications of nucleomonomers, particularly of a sugar moiety, include, for example, replacement of one or more of the hydroxyl groups with a halogen, a heteroatom, an aliphatic group, or the functionalization of the hydroxyl group as an ether, an amine, a thiol, or the like.

One particularly useful group of modified nucleomonomers are 2'-O-methyl nucleotides. Such 2'-O-methyl nucleotides may be referred to as "methylated," and the corresponding nucleotides may be made from unmethylated nucleotides followed by alkylation or directly from methylated nucleotide reagents. Modified nucleomonomers may be used in combination with unmodified nucleomonomers. For example, an oligonucleotide of the invention may contain both methylated and unmethylated nucleomonomers.

Some exemplary modified nucleomonomers include sugar- or backbone-modified ribonucleotides. Modified ribonucleotides may contain a non-naturally occurring base (instead of a naturally occurring base), such as uridines or cytidines modified at the 5'-position, e.g., 5'-(2-amino)propyl uridine and 5'-bromo uridine; adenosines and guanosines modified at the 8-position, e.g., 8-bromo guanosine; deaza nucleotides, e.g., 7-deaza-adenosine; and N-alkylated nucleotides, e.g., N6-methyl adenosine. Also, sugar-modified ribonucleotides may have the 2'-OH group replaced by a H, alxoxy (or OR), R or alkyl, halogen, SH, SR, amino (such as $NH_2$, NHR, $NR_2$,), or CN group, wherein R is lower alkyl, alkenyl, or alkynyl.

Modified ribonucleotides may also have the phosphodiester group connecting to adjacent ribonucleotides replaced by a modified group, e.g., of phosphorothioate group. More generally, the various nucleotide modifications may be combined.

Although the antisense (guide) strand may be substantially identical to at least a portion of the target gene (or genes), at least with respect to the base pairing properties, the sequence need not be perfectly identical to be useful, e.g., to inhibit expression of a target gene's phenotype. Generally, higher homology can be used to compensate for the use of a shorter antisense gene. In some cases, the antisense strand generally will be substantially identical (although in antisense orientation) to the target gene.

The use of 2'-O-methyl modified RNA may also be beneficial in circumstances in which it is desirable to minimize cellular stress responses. RNA having 2'-O-methyl nucleomonomers may not be recognized by cellular machinery that is thought to recognize unmodified RNA. The use of 2'-O-methylated or partially 2'-O-methylated RNA may avoid the interferon response to double-stranded nucleic acids, while maintaining target RNA inhibition. This may be useful, for example, for avoiding the interferon or other cellular stress responses, both in short RNAi (e.g., siRNA) sequences that induce the interferon response, and in longer RNAi sequences that may induce the interferon response.

Overall, modified sugars may include D-ribose, 2'-O-alkyl (including 2'-O-methyl and 2'-O-ethyl), i.e., 2'-alkoxy, 2'-amino, 2'-S-alkyl, 2'-halo (including 2'-fluoro), 2'-methoxyethoxy, 2'-allyloxy (—$OCH_2CH=CH_2$), 2'-propargyl, 2'-propyl, ethynyl, ethenyl, propenyl, and cyano and the like. In one embodiment, the sugar moiety can be a hexose and incorporated into an oligonucleotide as described (Augustyns, K., et al., *Nucl. Acids. Res.* 18:4711 (1992)). Exemplary nucleomonomers can be found, e.g., in U.S. Pat. No. 5,849,902, incorporated by reference herein.

Definitions of specific functional groups and chemical terms are described in more detail below. For purposes of this invention, the chemical elements are identified in accordance with the Periodic Table of the Elements, CAS version, *Handbook of Chemistry and Physics*, 75$^{th}$ Ed., inside cover, and specific functional groups are generally defined as described therein. Additionally, general principles of organic chemistry, as well as specific functional moieties and reactivity, are described in *Organic Chemistry*, Thomas Sorrell, University Science Books, Sausalito: 1999, the entire contents of which are incorporated herein by reference.

Certain compounds of the present invention may exist in particular geometric or stereoisomeric forms. The present invention contemplates all such compounds, including cis- and trans-isomers, R- and S-enantiomers, diastereomers, (D)-isomers, (L)-isomers, the racemic mixtures thereof, and other mixtures thereof, as falling within the scope of the invention. Additional asymmetric carbon atoms may be present in a substituent such as an alkyl group. All such isomers, as well as mixtures thereof, are intended to be included in this invention.

Isomeric mixtures containing any of a variety of isomer ratios may be utilized in accordance with the present invention. For example, where only two isomers are combined, mixtures containing 50:50, 60:40, 70:30, 80:20, 90:10, 95:5, 96:4, 97:3, 98:2, 99:1, or 100:0 isomer ratios are all contemplated by the present invention. Those of ordinary skill in the art will readily appreciate that analogous ratios are contemplated for more complex isomer mixtures.

If, for instance, a particular enantiomer of a compound of the present invention is desired, it may be prepared by asymmetric synthesis, or by derivation with a chiral auxiliary, where the resulting diastereomeric mixture is separated and the auxiliary group cleaved to provide the pure desired enantiomers. Alternatively, where the molecule contains a basic functional group, such as amino, or an acidic functional group, such as carboxyl, diastereomeric salts are formed with an appropriate optically-active acid or base, followed by resolution of the diastereomers thus formed by fractional crystallization or chromatographic means well known in the art, and subsequent recovery of the pure enantiomers.

In certain embodiments, oligonucleotides of the invention comprise 3' and 5' termini (except for circular oligonucleotides). In one embodiment, the 3' and 5' termini of an oligonucleotide can be substantially protected from nucleases e.g., by modifying the 3' or 5' linkages (e.g., U.S. Pat. No. 5,849, 902 and WO 98/13526). For example, oligonucleotides can be made resistant by the inclusion of a "blocking group." The term "blocking group" as used herein refers to substituents (e.g., other than OH groups) that can be attached to oligonucleotides or nucleomonomers, either as protecting groups or coupling groups for synthesis (e.g., FITC, propyl ($CH_2$—$CH_2$—$CH_3$), glycol (—O—$CH_2$—$CH_2$—O—) phosphate ($PO_3^{2-}$), hydrogen phosphonate, or phosphoramidite). "Blocking groups" also include "end blocking groups" or "exonuclease blocking groups" which protect the 5' and 3' termini of the oligonucleotide, including modified nucleotides and non-nucleotide exonuclease resistant structures.

Exemplary end-blocking groups include cap structures (e.g., a 7-methylguanosine cap), inverted nucleomonomers, e.g., with 3'-3' or 5'-5' end inversions (see, e.g., Ortiagao et al. 1992. *Antisense Res. Dev.* 2:129), methylphosphonate, phosphoramidite, non-nucleotide groups (e.g., non-nucleotide linkers, amino linkers, conjugates) and the like. The 3' terminal nucleomonomer can comprise a modified sugar moiety. The 3' terminal nucleomonomer comprises a 3'-O that can optionally be substituted by a blocking group that prevents 3'-exonuclease degradation of the oligonucleotide. For example, the 3'-hydroxyl can be esterified to a nucleotide through a 3'→3' internucleotide linkage. For example, the alkyloxy radical can be methoxy, ethoxy, or isopropoxy, and preferably, ethoxy. Optionally, the 3'→3' linked nucleotide at the 3' terminus can be linked by a substitute linkage. To reduce nuclease degradation, the 5' most 3'→5' linkage can be a modified linkage, e.g., a phosphorothioate or a P-alkyloxyphosphotriester linkage. Preferably, the two 5' most 3'→5' linkages are modified linkages. Optionally, the 5' terminal hydroxy moiety can be esterified with a phosphorus containing moiety, e.g., phosphate, phosphorothioate, or P-ethoxyphosphate.

One of ordinary skill in the art will appreciate that the synthetic methods, as described herein, utilize a variety of protecting groups. By the term "protecting group," as used herein, it is meant that a particular functional moiety, e.g., O, S, or N, is temporarily blocked so that a reaction can be carried out selectively at another reactive site in a multifunctional compound. In certain embodiments, a protecting group reacts selectively in good yield to give a protected substrate that is stable to the projected reactions; the protecting group should be selectively removable in good yield by readily available, preferably non-toxic reagents that do not attack the other functional groups; the protecting group forms an easily separable derivative (more preferably without the generation of new stereogenic centers); and the protecting group has a minimum of additional functionality to avoid further sites of reaction. As detailed herein, oxygen, sulfur, nitrogen, and carbon protecting groups may be utilized. Hydroxyl protecting groups include methyl, methoxylmethyl (MOM), methylthiomethyl (MTM), t-butylthiomethyl, (phenyldimethylsilyl)methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichloroethoxymethyl, bis(2-chloroethoxy)methyl, 2-(trimethylsilyl)ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a,4,5,6,7,7a-octahydro-7,8,8-trimethyl-4,7-methanobenzofuran-2-yl, 1-ethoxyethyl, 1-(2-chloroethoxy)ethyl, 1-methyl-1-methoxyethyl, 1-methyl-1-benzyloxyethyl, 1-methyl-1-benzyloxy-2-fluoroethyl, 2,2,2-trichloroethyl, 2-trimethylsilylethyl, 2-(phenylselenyl)ethyl, t-butyl, allyl, p-chlorophenyl, p-methoxyphenyl, 2,4-dinitrophenyl, benzyl, p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxido, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4"-tris(4,5-dichlorophthalimidophenyl)methyl, 4,4',4"-tris(levulinoyloxyphenyl)methyl, 4,4',4"-tris(benzoyloxyphenyl)methyl, 3-(imidazol-1-yl)bis(4',4"-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), t-butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio)pentanoate (levulinoyldithioacetal), pivaloate, adamantoate, crotonate, 4-methoxycrotonate, benzoate, p-phenylbenzoate, 2,4,6-trimethylbenzoate (mesitoate), alkyl methyl carbonate, 9-fluorenylmethyl carbonate (Fmoc), alkyl ethyl carbonate, alkyl 2,2,2-trichloroethyl carbonate (Troc), 2-(trimethylsilyl)ethyl carbonate (TMSEC), 2-(phenylsulfonyl)ethyl carbonate (Psec), 2-(triphenylphosphonio) ethyl carbonate (Peoc), alkyl isobutyl carbonate, alkyl vinyl carbonate alkyl allyl carbonate, alkyl p-nitrophenyl carbonate, alkyl benzyl carbonate, alkyl p-methoxybenzyl carbonate, alkyl 3,4-dimethoxybenzyl carbonate, alkyl o-nitrobenzyl carbonate, alkyl p-nitrobenzyl carbonate, alkyl S-benzyl thiocarbonate, 4-ethoxy-1-napththyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy)butyrate, 2-(methylthiomethoxymethyl)benzoate, 2,6-dichloro-4-methylphenoxyacetate, 2,6-dichloro-4-(1,1,3,3-tetramethylbutyl)phenoxyacetate, 2,4-bis(1,1-dimethylpropyl)phenoxyacetate, chlorodiphenylacetate, isobutyrate, monosuccinoate, (E)-2-methyl-2-butenoate, o-(methoxycarbonyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). For protecting 1,2- or 1,3-diols, the protecting groups include methylene acetal, ethylidene acetal, 1-t-butylethylidene ketal, 1-phenylethylidene ketal, (4-methoxyphenyl)ethylidene acetal, 2,2,2-trichloroethylidene acetal, acetonide, cyclopentylidene ketal, cyclohexylidene ketal, cycloheptylidene ketal, benzylidene acetal, p-methoxybenzylidene acetal, 2,4-dimethoxybenzylidene ketal, 3,4-dimethoxybenzylidene acetal, 2-nitrobenzylidene acetal, methoxymethylene acetal, ethoxymethylene acetal, dimethoxymethylene ortho ester, 1-methoxyethylidene ortho ester, 1-ethoxyethylidine ortho ester, 1,2-dimethoxyethylidene ortho ester, α-methoxybenzylidene ortho ester, 1-(N,N-dimethylamino)ethylidene derivative, α-(N,N'-dimethylamino)benzylidene derivative, 2-oxacyclopentylidene ortho ester, di-t-butylsilylene group (DTBS), 1,3-(1,1,3,3-tetraisopropyldisiloxanylidene) derivative (TIPDS), tetra-t-butoxydisiloxane-1,3-diylidene derivative (TBDS), cyclic carbonates, cyclic boronates, ethyl boronate, and phenyl boronate. Amino-protecting groups include methyl carbamate, ethyl carbamate, 9-fluorenylmethyl carbamate (Fmoc), 9-(2-sulfo)fluorenylmethyl carbamate, 9-(2,7-dibromo)fluoroenylmethyl carbamate, 2,7-di-t-butyl-[9-(10,10-dioxo-10,10, 10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methylsulfonylethyl carbamate, 2-(ptoluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, phenothiazinyl-(10)-carbonyl derivative, N'-p-toluenesulfonylaminocarbonyl derivative, N'-phenylaminothiocarbonyl derivative, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxycarbonylvinyl carbamate, o-(N,N-dimethylcarboxamido)benzyl carbamate, 1,1-dimethyl-3-(N,N-dimethylcarboxamido)propyl carbamate, 1,1-dimethylpropynyl carbamate, di(2-pyridyl)methyl carbamate, 2-furanylmethyl carbamate, 2-iodoethyl carbamate, isobornyl carbamate, isobutyl carbamate, isonicotinyl carbamate, p-(p'-methoxyphenylazo)benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(pphenylazophenyl)ethyl carbamate, 1-methyl-1-phenylethyl carbamate, 1-methyl-1-(4-pyridyl)ethyl carbamate, phenyl carbamate, p-(phenylazo)benzyl carbamate, 2,4,6-tri-t-butylphenyl carbamate, 4-(trimethylammonium)benzyl carbamate, 2,4,6-trimethylbenzyl carbamate, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitophenylacetamide, o-nitrophenoxyacetamide, acetoacetamide, (N'-dithiobenzyloxycarbonylamino)acetamide, 3-(phydroxyphenyl)propanamide, 3-(o-nitrophenyl)propanamide, 2-methyl-2-(o-nitrophenoxy)propanamide, 2-methyl-2-(o-phenylazophenoxy)propanamide, 4-chlorobutanamide, 3-methyl-3-nitrobutanamide, o-nitrocinnamide, N-acetylmethionine derivative, o-nitrobenzamide, o-(benzoyloxymethyl)benzamide, 4,5-diphenyl-3-oxazolin-2-one, N-phthalimide, N-dithiasuccinimide (Dts), N-2,3-diphenyl-maleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N-(1-isopropyl-4-nitro-2-oxo-3-pyroolin-3-yl)amine, quaternary ammonium salts, N-benzylamine, N-di(4-methoxyphenyl)methylamine, N-5-dibenzosuberylamine, N-triphenylmethylamine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fern), N-2-picolylamino N'-oxide, N-1,1-dimethylthiomethyleneamine, N-benzylideneamine, N-p-methoxybenzylideneamine, N-diphenylmethyleneamine, N-[(2-pyridyl)mesityl]methyleneamine, N—(N',N'-dimethylaminomethylene)amine, N,N'-isopropylidenediamine, N-p-nitrobenzylideneamine, N-salicylideneamine, N-5-chlorosalicylideneamine, N-(5-chloro-2-hydroxyphenyl)phenylmethyleneamine, N-cyclohexylideneamine, N-(5,5-dimethyl-3-oxo-1-cyclohexenyl)amine, N-borane derivative, N-diphenylborinic acid derivative, N-[phenyl(pentacarbonylchromium- or tungsten)carbonyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphoramidate, benzenesulfenamide, o-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, 3-nitropyridinesulfenamide (Npys), p-toluenesulfonamide (Ts), benzenesulfonamide, 2,3,6,-trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pmc), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide. Exemplary protecting groups are detailed herein. However, it will be appreciated that the present invention is not intended to be limited to these protecting groups; rather, a variety of additional equivalent protecting groups can be readily identified using the above criteria and utilized in the method of the present invention. Additionally, a variety of protecting groups are described in *Protective Groups in Organic Synthesis*, Third Ed. Greene, T. W. and Wuts, P. G., Eds., John Wiley & Sons, New York: 1999, the entire contents of which are hereby incorporated by reference.

It will be appreciated that the compounds, as described herein, may be substituted with any number of substituents or functional moieties. In general, the term "substituted" whether preceded by the term "optionally" or not, and substituents contained in formulas of this invention, refer to the replacement of hydrogen radicals in a given structure with the radical of a specified substituent. When more than one position in any given structure may be substituted with more than one substituent selected from a specified group, the substituent may be either the same or different at every position. As used herein, the term "substituted" is contemplated to include all permissible substituents of organic compounds. In a broad aspect, the permissible substituents include acyclic and cyclic, branched and unbranched, carbocyclic and heterocyclic, aromatic and nonaromatic substituents of organic compounds. Heteroatoms such as nitrogen may have hydrogen substituents and/or any permissible substituents of organic compounds described herein which satisfy the valencies of the heteroatoms. Furthermore, this invention is not intended to be limited in any manner by the permissible substituents of organic compounds. Combinations of substituents and variables envisioned by this invention are preferably those that result in the formation of stable compounds useful in the treatment, for example, of infectious diseases or proliferative disorders. The term "stable", as used herein, preferably refers to compounds which possess stability sufficient to allow manufacture and which maintain the integrity of the compound for a sufficient period of time to be detected and preferably for a sufficient period of time to be useful for the purposes detailed herein.

The term "aliphatic," as used herein, includes both saturated and unsaturated, straight chain (i.e., unbranched), branched, acyclic, cyclic, or polycyclic aliphatic hydrocarbons, which are optionally substituted with one or more functional groups. As will be appreciated by one of ordinary skill in the art, "aliphatic" is intended herein to include, but is not limited to, alkyl, alkenyl, alkynyl, cycloalkyl, cycloalkenyl, and cycloalkynyl moieties. Thus, as used herein, the term "alkyl" includes straight, branched and cyclic alkyl groups. An analogous convention applies to other generic terms such as "alkenyl," "alkynyl," and the like. Furthermore, as used herein, the terms "alkyl," "alkenyl," "alkynyl," and the like encompass both substituted and unsubstituted groups. In certain embodiments, as used herein, "lower alkyl" is used to indicate those alkyl groups (cyclic, acyclic, substituted, unsubstituted, branched, or unbranched) having 1-6 carbon atoms.

In certain embodiments, the alkyl, alkenyl, and alkynyl groups employed in the invention contain 1-20 aliphatic carbon atoms. In certain other embodiments, the alkyl, alkenyl, and alkynyl groups employed in the invention contain 1-10 aliphatic carbon atoms. In yet other embodiments, the alkyl, alkenyl, and alkynyl groups employed in the invention contain 1-8 aliphatic carbon atoms. In still other embodiments, the alkyl, alkenyl, and alkynyl groups employed in the invention contain 1-6 aliphatic carbon atoms. In yet other embodiments, the alkyl, alkenyl, and alkynyl groups employed in the invention contain 1-4 carbon atoms. Illustrative aliphatic groups thus include, but are not limited to, for example, methyl, ethyl, n-propyl, isopropyl, cyclopropyl, —CH$_2$-cyclopropyl, vinyl, allyl, n-butyl, sec-butyl, isobutyl, tert-butyl, cyclobutyl, —CH$_2$-cyclobutyl, n-pentyl, sec-pentyl, isopentyl, tert-pentyl, cyclopentyl, —CH$_2$-cyclopentyl, n-hexyl, sec-hexyl, cyclohexyl, —CH$_2$-cyclohexyl moieties and the like, which again, may bear one or more substituents. Alkenyl groups include, but are not limited to, for example, ethenyl, propenyl, butenyl, 1-methyl-2-buten-1-yl, and the like. Representative alkynyl groups include, but are not limited to, ethynyl, 2-propynyl(propargyl), 1-propynyl, and the like.

Some examples of substituents of the above-described aliphatic (and other) moieties of compounds of the invention include, but are not limited to aliphatic; heteroaliphatic; aryl; heteroaryl; arylalkyl; heteroarylalkyl; alkoxy; aryloxy; heteroalkoxy; heteroaryloxy; alkylthio; arylthio; heteroalkylthio; heteroarylthio; —F; —Cl; —Br; —I; —OH; —NO$_2$; —CN; —CF$_3$; —CH$_2$CF$_3$; —CHCl$_2$; —CH$_2$OH; —CH$_2$CH$_2$OH; —CH$_2$NH$_2$; —CH$_2$SO$_2$CH$_3$; —C(O)R$_x$; —CO$_2$(R$_x$); —CON(R$_x$)$_2$; —OC(O)R$_x$; —OCO$_2$R$_x$; —OCON(R$_x$)$_2$; —N(R$_x$)$_2$; —S(O)$_2$R$_x$; —NR$_x$(CO)R$_x$ wherein each occurrence of R$_x$ independently includes, but is not limited to, aliphatic, heteroaliphatic, aryl, heteroaryl, arylalkyl, or heteroarylalkyl, wherein any of the aliphatic, heteroaliphatic, arylalkyl, or heteroarylalkyl substituents described above and herein may be substituted or unsubstituted, branched or unbranched, cyclic or acyclic, and wherein any of the aryl or heteroaryl substituents described above and herein may be substituted or unsubstituted. Additional examples of generally applicable substituents are illustrated by the specific embodiments described herein.

The term "heteroaliphatic," as used herein, refers to aliphatic moieties that contain one or more oxygen, sulfur, nitrogen, phosphorus, or silicon atoms, e.g., in place of carbon atoms. Heteroaliphatic moieties may be branched, unbranched, cyclic or acyclic and include saturated and unsaturated heterocycles such as morpholino, pyrrolidinyl, etc. In certain embodiments, heteroaliphatic moieties are substituted by independent replacement of one or more of the hydrogen atoms thereon with one or more moieties including, but not limited to aliphatic; heteroaliphatic; aryl; heteroaryl; arylalkyl; heteroarylalkyl; alkoxy; aryloxy; heteroalkoxy; heteroaryloxy; alkylthio; arylthio; heteroalkylthio; heteroarylthio; —F; —Cl; —Br; —I; —OH; —NO$_2$; —CN; —CF$_3$; —CH$_2$CF$_3$; —CHCl$_2$; —CH$_2$OH; —CH$_2$CH$_2$OH; —CH$_2$NH$_2$; —CH$_2$SO$_2$CH$_3$; —C(O)R$_x$; —CO$_2$(R$_x$); —CON(R$_x$)$_2$; —OC(O)R$_x$; —OCO$_2$R$_x$; —OCON(R$_x$)$_2$; —N(R$_x$)$_2$; —S(O)$_2$R$_x$; —NR$_x$(CO)R$_x$, wherein each occurrence of R$_x$ independently includes, but is not limited to, aliphatic, heteroaliphatic, aryl, heteroaryl, arylalkyl, or heteroarylalkyl, wherein any of the aliphatic, heteroaliphatic, arylalkyl, or heteroarylalkyl substituents described above and herein may be substituted or unsubstituted, branched or unbranched, cyclic or acyclic, and wherein any of the aryl or heteroaryl substituents described above and herein may be substituted or unsubstituted. Additional examples of generally applicable substitutents are illustrated by the specific embodiments described herein.

The terms "halo" and "halogen" as used herein refer to an atom selected from fluorine, chlorine, bromine, and iodine.

The term "alkyl" includes saturated aliphatic groups, including straight-chain alkyl groups (e.g., methyl, ethyl, propyl, butyl, pentyl, hexyl, heptyl, octyl, nonyl, decyl, etc.), branched-chain alkyl groups (isopropyl, tert-butyl, isobutyl, etc.), cycloalkyl (alicyclic) groups (cyclopropyl, cyclopentyl, cyclohexyl, cycloheptyl, cyclooctyl), alkyl substituted cycloalkyl groups, and cycloalkyl substituted alkyl groups. In certain embodiments, a straight chain or branched chain alkyl has 6 or fewer carbon atoms in its backbone (e.g., $C_1$-$C_6$ for straight chain, $C_3$-$C_6$ for branched chain), and more preferably 4 or fewer. Likewise, preferred cycloalkyls have from 3-8 carbon atoms in their ring structure, and more preferably have 5 or 6 carbons in the ring structure. The term $C_1$-$C_6$ includes alkyl groups containing 1 to 6 carbon atoms.

Moreover, unless otherwise specified, the term alkyl includes both "unsubstituted alkyls" and "substituted alkyls," the latter of which refers to alkyl moieties having independently selected substituents replacing a hydrogen on one or more carbons of the hydrocarbon backbone. Such substituents can include, for example, alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety. Cycloalkyls can be further substituted, e.g., with the substituents described above. An "alkylaryl" or an "arylalkyl" moiety is an alkyl substituted with an aryl (e.g., phenylmethyl(benzyl)). The term "alkyl" also includes the side chains of natural and unnatural amino acids. The term "n-alkyl" means a straight chain (i.e., unbranched) unsubstituted alkyl group.

The term "alkenyl" includes unsaturated aliphatic groups analogous in length and possible substitution to the alkyls described above, but that contain at least one double bond. For example, the term "alkenyl" includes straight-chain alkenyl groups (e.g., ethylenyl, propenyl, butenyl, pentenyl, hexenyl, heptenyl, octenyl, nonenyl, decenyl, etc.), branched-chain alkenyl groups, cycloalkenyl (alicyclic) groups (cyclopropenyl, cyclopentenyl, cyclohexenyl, cycloheptenyl, cyclooctenyl), alkyl or alkenyl substituted cycloalkenyl groups, and cycloalkyl or cycloalkenyl substituted alkenyl groups. In certain embodiments, a straight chain or branched chain alkenyl group has 6 or fewer carbon atoms in its backbone (e.g., $C_2$-$C_6$ for straight chain, $C_3$-$C_6$ for branched chain). Likewise, cycloalkenyl groups may have from 3-8 carbon atoms in their ring structure, and more preferably have 5 or 6 carbons in the ring structure. The term $C_2$-$C_6$ includes alkenyl groups containing 2 to 6 carbon atoms.

Moreover, unless otherwise specified, the term alkenyl includes both "unsubstituted alkenyls" and "substituted alkenyls," the latter of which refers to alkenyl moieties having independently selected substituents replacing a hydrogen on one or more carbons of the hydrocarbon backbone. Such substituents can include, for example, alkyl groups, alkynyl groups, halogens, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

The term "alkynyl" includes unsaturated aliphatic groups analogous in length and possible substitution to the alkyls described above, but which contain at least one triple bond. For example, the term "alkynyl" includes straight-chain alkynyl groups (e.g., ethynyl, propynyl, butynyl, pentynyl, hexynyl, heptynyl, octynyl, nonynyl, decynyl, etc.), branched-chain alkynyl groups, and cycloalkyl or cycloalkenyl substituted alkynyl groups. In certain embodiments, a straight chain or branched chain alkynyl group has 6 or fewer carbon atoms in its backbone (e.g., $C_2$-$C_6$ for straight chain, $C_3$-$C_6$ for branched chain). The term $C_2$-$C_6$ includes alkynyl groups containing 2 to 6 carbon atoms.

Moreover, unless otherwise specified, the term alkynyl includes both "unsubstituted alkynyls" and "substituted alkynyls," the latter of which refers to alkynyl moieties having independently selected substituents replacing a hydrogen on one or more carbons of the hydrocarbon backbone. Such substituents can include, for example, alkyl groups, alkynyl groups, halogens, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

Unless the number of carbons is otherwise specified, "lower alkyl" as used herein means an alkyl group, as defined above, but having from one to five carbon atoms in its backbone structure. "Lower alkenyl" and "lower alkynyl" have chain lengths of, for example, 2-5 carbon atoms.

The term "alkoxy" includes substituted and unsubstituted alkyl, alkenyl, and alkynyl groups covalently linked to an oxygen atom. Examples of alkoxy groups include methoxy, ethoxy, isopropyloxy, propoxy, butoxy, and pentoxy groups. Examples of substituted alkoxy groups include halogenated alkoxy groups. The alkoxy groups can be substituted with independently selected groups such as alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulffiydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moieties. Examples of halogen substituted alkoxy groups include, but are not limited to, fluoromethoxy, difluoromethoxy, trifluoromethoxy, chloromethoxy, dichloromethoxy, trichloromethoxy, etc.

The term "hydrophobic modifications' include bases modified in a fashion, where (1) overall hydrophobicity of the base is significantly increases, (2) the base is still capable of forming close to regular Watson-Crick interaction. Some, of the examples of base modifications include but are not limited to 5-position uridine and cytidine modifications like phenyl, 4-pyridyl, 2-pyridyl, indolyl, and isobutyl, phenyl (C6H5OH); tryptophanyl (C8H6N)CH2CH(NH2)CO), Isobutyl, butyl, aminobenzyl; phenyl; naphthyl, For purposes of the present invention, the term "overhang" refers to terminal non-base pairing nucleotide(s) resulting from one strand or region extending beyond the terminus of the complementary strand to which the first strand or region forms a duplex. One or more polynucleotides that are capable of forming a duplex through hydrogen bonding can have overhangs. The overhand length generally doesn't exceed 5 bases in length.

The term "heteroatom" includes atoms of any element other than carbon or hydrogen. Preferred heteroatoms are nitrogen, oxygen, sulfur and phosphorus.

The term "hydroxy" or "hydroxyl" includes groups with an —OH or —O⁻ (with an appropriate counterion).

The term "halogen" includes fluorine, bromine, chlorine, iodine, etc. The term "perhalogenated" generally refers to a moiety wherein all hydrogens are replaced by halogen atoms.

The term "substituted" includes independently selected substituents which can be placed on the moiety and which allow the molecule to perform its intended function. Examples of substituents include alkyl, alkenyl, alkynyl, aryl, $(CR'R'')_{0-3}NR'R''$, $(CR'R'')_{0-3}CN$, $NO_2$, halogen, $(CR'R'')_{0-3}C(halogen)_3$, $(CR'R'')_{0-3}CH(halogen)_2$, $(CR'R'')_{0-3}CH_2(halogen)$, $(CR'R'')_{0-3}CONR'R''$, $(CR'R'')_{0-3}S(O)_{1-2}NR'R''$, $(CR'R'')_{0-3}CHO$, $(CR'R'')_{0-3}O(CR'R'')_{0-3}H$, (CR'R")$_{0-3}$S(O)$_{0-2}$R', (CR'R")$_{0-3}$O(CR'R")$_{0-3}$H, (CR'R")$_{0-3}$COR', (CR'R")$_{0-3}$CO$_2$R', or (CR'R")$_{0-3}$OR' groups; wherein each R' and R" are each independently hydrogen, a C$_1$-C$_5$ alkyl, C$_2$-C$_5$ alkenyl, C$_2$-C$_5$ alkynyl, or aryl group, or R' and R" taken together are a benzylidene group or a —(CH$_2$)$_2$O(CH$_2$)$_2$— group.

The term "amine" or "amino" includes compounds or moieties in which a nitrogen atom is covalently bonded to at least one carbon or heteroatom. The term "alkyl amino" includes groups and compounds wherein the nitrogen is bound to at least one additional alkyl group. The term "dialkyl amino" includes groups wherein the nitrogen atom is bound to at least two additional alkyl groups.

The term "ether" includes compounds or moieties which contain an oxygen bonded to two different carbon atoms or heteroatoms. For example, the term includes "alkoxyalkyl," which refers to an alkyl, alkenyl, or alkynyl group covalently bonded to an oxygen atom which is covalently bonded to another alkyl group.

The terms "polynucleotide," "nucleotide sequence," "nucleic acid," "nucleic acid molecule," "nucleic acid sequence," and "oligonucleotide" refer to a polymer of two or more nucleotides. The polynucleotides can be DNA, RNA, or derivatives or modified versions thereof. The polynucleotide may be single-stranded or double-stranded. The polynucleotide can be modified at the base moiety, sugar moiety, or phosphate backbone, for example, to improve stability of the molecule, its hybridization parameters, etc. The polynucleotide may comprise a modified base moiety which is selected from the group including but not limited to 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid, 5-methyl-2-thiouracil, 3-(3-amino-3-N-2-carboxypropyl) uracil, and 2,6-diaminopurine. The olynucleotide may comprise a modified sugar moiety (e.g., 2'-fluororibose, ribose, 2'-deoxyribose, 2'-O-methylcytidine, arabinose, and hexose), and/or a modified phosphate moiety (e.g., phosphorothioates and 5'-N-phosphoramidite linkages). A nucleotide sequence typically carries genetic information, including the information used by cellular machinery to make proteins and enzymes. These terms include double- or single-stranded genomic and cDNA, RNA, any synthetic and genetically manipulated polynucleotide, and both sense and antisense polynucleotides. This includes single- and double-stranded molecules, i.e., DNA-DNA, DNA-RNA, and RNA-RNA hybrids, as well as "protein nucleic acids" (PNA) formed by conjugating bases to an amino acid backbone.

The term "base" includes the known purine and pyrimidine heterocyclic bases, deazapurines, and analogs (including heterocyclic substituted analogs, e.g., aminoethyoxy phenoxazine), derivatives (e.g., 1-alkyl-, 1-alkenyl-, heteroaromatic- and 1-alkynyl derivatives) and tautomers thereof. Examples of purines include adenine, guanine, inosine, diaminopurine, and xanthine and analogs (e.g., 8-oxo-N$^6$-methyladenine or 7-diazaxanthine) and derivatives thereof. Pyrimidines include, for example, thymine, uracil, and cytosine, and their analogs (e.g., 5-methylcytosine, 5-methyluracil, 5-(1-propynyl)uracil, 5-(1-propynyl)cytosine and 4,4-ethanocytosine). Other examples of suitable bases include non-purinyl and non-pyrimidinyl bases such as 2-aminopyridine and triazines.

In a preferred embodiment, the nucleomonomers of an oligonucleotide of the invention are RNA nucleotides. In another preferred embodiment, the nucleomonomers of an oligonucleotide of the invention are modified RNA nucleotides. Thus, the oligonucleotides contain modified RNA nucleotides.

The term "nucleoside" includes bases which are covalently attached to a sugar moiety, preferably ribose or deoxyribose. Examples of preferred nucleosides include ribonucleosides and deoxyribonucleosides. Nucleosides also include bases linked to amino acids or amino acid analogs which may comprise free carboxyl groups, free amino groups, or protecting groups. Suitable protecting groups are well known in the art (see P. G. M. Wuts and T. W. Greene, "Protective Groups in Organic Synthesis", 2$^{nd}$ Ed., Wiley-Interscience, New York, 1999).

The term "nucleotide" includes nucleosides which further comprise a phosphate group or a phosphate analog.

The nucleic acid molecules may be associated with a hydrophobic moiety for targeting and/or delivery of the molecule to a cell. In certain embodiments, the hydrophobic moiety is associated with the nucleic acid molecule through a linker. In certain embodiments, the association is through non-covalent interactions. In other embodiments, the association is through a covalent bond. Any linker known in the art may be used to associate the nucleic acid with the hydrophobic moiety. Linkers known in the art are described in published international PCT applications, WO 92/03464, WO 95/23162, WO 2008/021157, WO 2009/021157, WO 2009/134487, WO 2009/126933, U.S. Patent Application Publication 2005/0107325, U.S. Pat. Nos. 5,414,077, 5,419,966, 5,512,667, 5,646,126, and 5,652,359, which are incorporated herein by reference. The linker may be as simple as a covalent bond to a multi-atom linker. The linker may be cyclic or acyclic. The linker may be optionally substituted. In certain embodiments, the linker is capable of being cleaved from the nucleic acid. In certain embodiments, the linker is capable of being hydrolyzed under physiological conditions. In certain embodiments, the linker is capable of being cleaved by an enzyme (e.g., an esterase or phosphodiesterase). In certain embodiments, the linker comprises a spacer element to separate the nucleic acid from the hydrophobic moiety. The spacer element may include one to thirty carbon or heteroatoms. In certain embodiments, the linker and/or spacer element comprises protonatable functional groups. Such protonatable functional groups may promote the endosomal escape of the nucleic acid molecule. The protonatable functional groups may also aid in the delivery of the nucleic acid to a cell, for example, neutralizing the overall charge of the molecule. In other embodiments, the linker and/or spacer element is biologically inert (that is, it does not impart biological activity or function to the resulting nucleic acid molecule).

In certain embodiments, the nucleic acid molecule with a linker and hydrophobic moiety is of the formulae described herein. In certain embodiments, the nucleic acid molecule is of the formula:

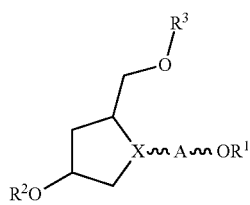

wherein

X is N or CH;

A is a bond; substituted or unsubstituted, cyclic or acyclic, branched or unbranched aliphatic; or substituted or unsubstituted, cyclic or acyclic, branched or unbranched heteroaliphatic;

R¹ is a hydrophobic moiety;

R² is hydrogen; an oxygen-protecting group; cyclic or acyclic, substituted or unsubstituted, branched or unbranched aliphatic; cyclic or acyclic, substituted or unsubstituted, branched or unbranched heteroaliphatic; substituted or unsubstituted, branched or unbranched acyl; substituted or unsubstituted, branched or unbranched aryl; substituted or unsubstituted, branched or unbranched heteroaryl; and R³ is a nucleic acid.

In certain embodiments, the molecule is of the formula:

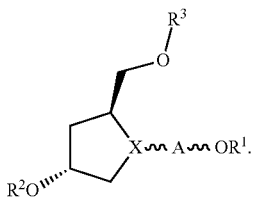

In certain embodiments, the molecule is of the formula:

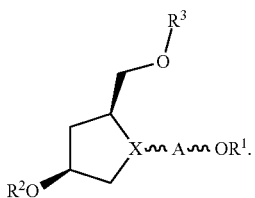

In certain embodiments, the molecule is of the formula:

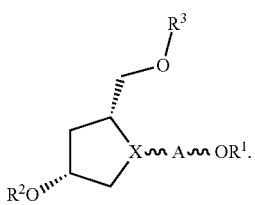

In certain embodiments, the molecule is of the formula:

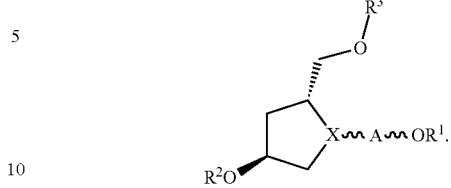

In certain embodiments, X is N. In certain embodiments, X is CH.

In certain embodiments, A is a bond. In certain embodiments, A is substituted or unsubstituted, cyclic or acyclic, branched or unbranched aliphatic. In certain embodiments, A is acyclic, substituted or unsubstituted, branched or unbranched aliphatic. In certain embodiments, A is acyclic, substituted, branched or unbranched aliphatic. In certain embodiments, A is acyclic, substituted, unbranched aliphatic. In certain embodiments, A is acyclic, substituted, unbranched alkyl. In certain embodiments, A is acyclic, substituted, unbranched $C_{1-20}$ alkyl. In certain embodiments, A is acyclic, substituted, unbranched $C_{1-12}$ alkyl. In certain embodiments, A is acyclic, substituted, unbranched $C_{1-10}$ alkyl. In certain embodiments, A is acyclic, substituted, unbranched $C_{1-8}$ alkyl. In certain embodiments, A is acyclic, substituted, unbranched $C_{1-6}$ alkyl. In certain embodiments, A is substituted or unsubstituted, cyclic or acyclic, branched or unbranched heteroaliphatic. In certain embodiments, A is acyclic, substituted or unsubstituted, branched or unbranched heteroaliphatic. In certain embodiments, A is acyclic, substituted, branched or unbranched heteroaliphatic. In certain embodiments, A is acyclic, substituted, unbranched heteroaliphatic.

In certain embodiments, A is of the formula:

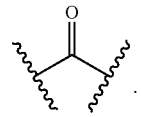

In certain embodiments, A is of one of the formulae:

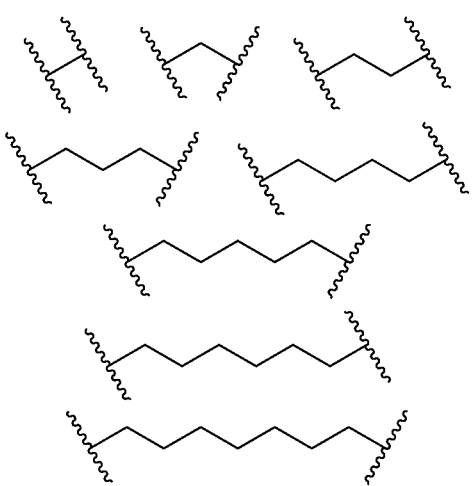

-continued

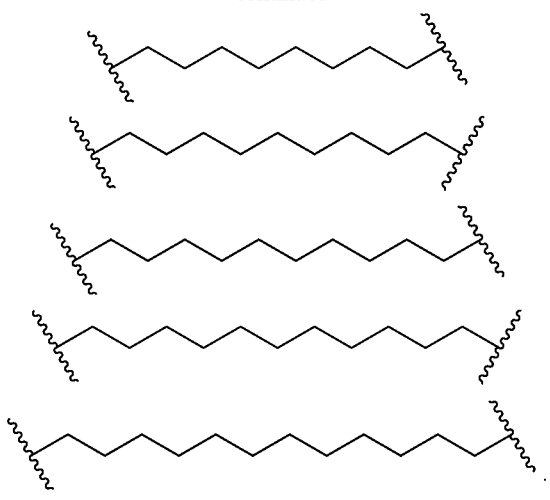

In certain embodiments, A is of one of the formulae:

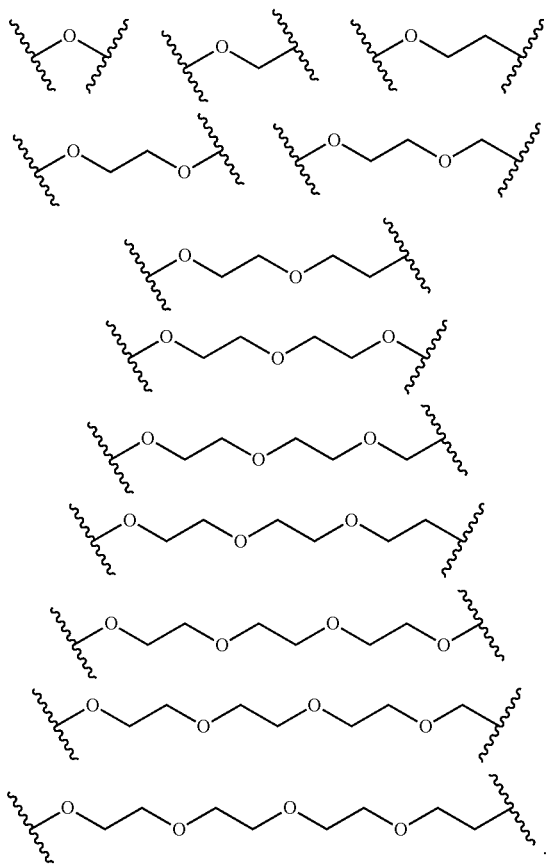

In certain embodiments, A is of one of the formulae:

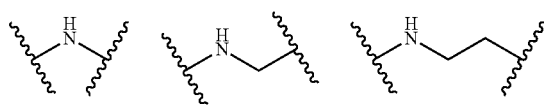

-continued

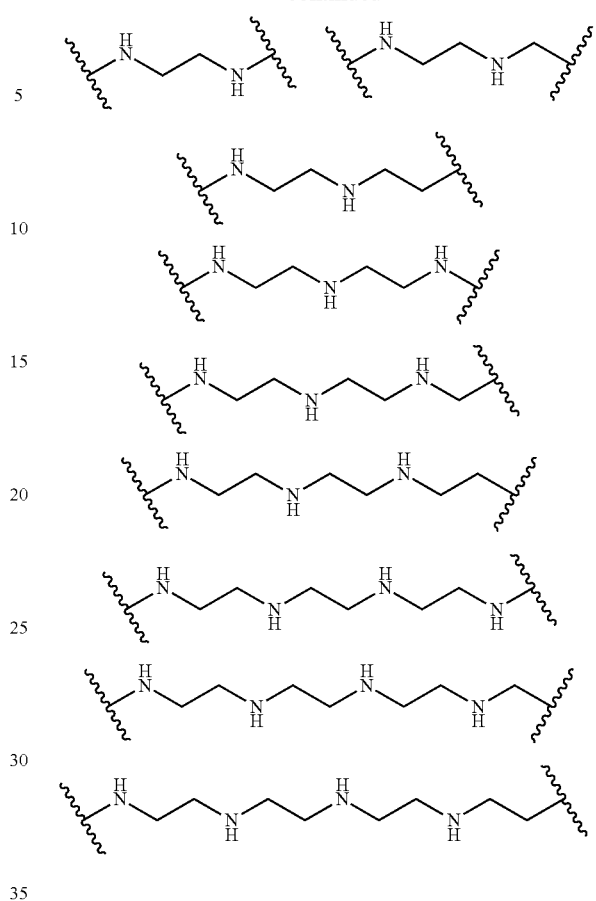

In certain embodiments, A is of the formula:

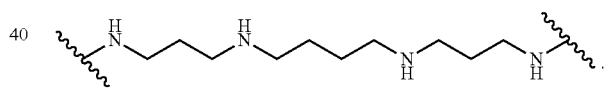

In certain embodiments, A is of the formula:

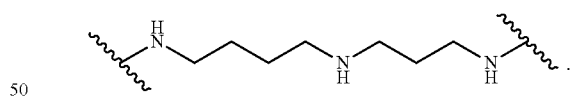

In certain embodiments, A is of the formula:

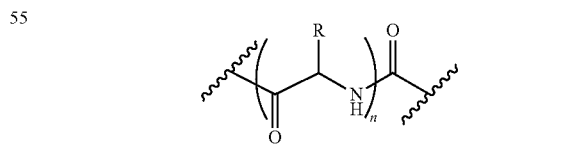

wherein each occurrence of R is independently the side chain of a natural or unnatural amino acid; and n is an integer between 1 and 20, inclusive. In certain embodiments, A is of the formula:

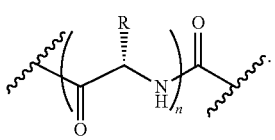

In certain embodiments, each occurrence of R is independently the side chain of a natural amino acid. In certain embodiments, n is an integer between 1 and 15, inclusive.

In certain embodiments, n is an integer between 1 and 10, inclusive. In certain embodiments, n is an integer between 1 and 5, inclusive.

In certain embodiments, A is of the formula:

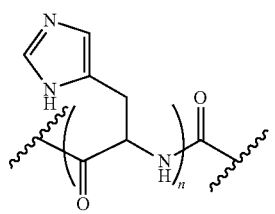

wherein n is an integer between 1 and 20, inclusive. In certain embodiments, A is of the formula:

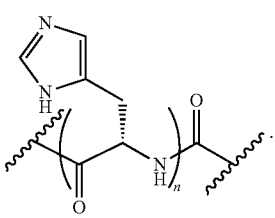

In certain embodiments, n is an integer between 1 and 15, inclusive. In certain embodiments, n is an integer between 1 and 10, inclusive. In certain embodiments, n is an integer between 1 and 5, inclusive.

In certain embodiments, A is of the formula:

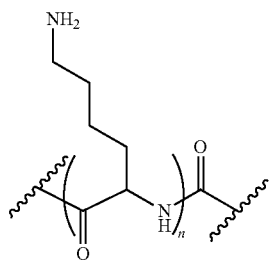

wherein n is an integer between 1 and 20, inclusive. In certain embodiments, A is of the formula:

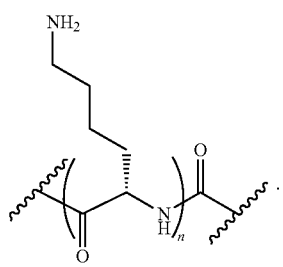

In certain embodiments, n is an integer between 1 and 15, inclusive. In certain embodiments, n is an integer between 1 and 10, inclusive. In certain embodiments, n is an integer between 1 and 5, inclusive.

In certain embodiments, the molecule is of the formula:

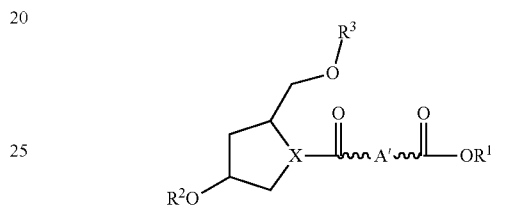

wherein X, $R^1$, $R^2$, and $R^3$ are as defined herein; and

A' is substituted or unsubstituted, cyclic or acyclic, branched or unbranched aliphatic; or substituted or unsubstituted, cyclic or acyclic, branched or unbranched heteroaliphatic.

In certain embodiments, A' is of one of the formulae:

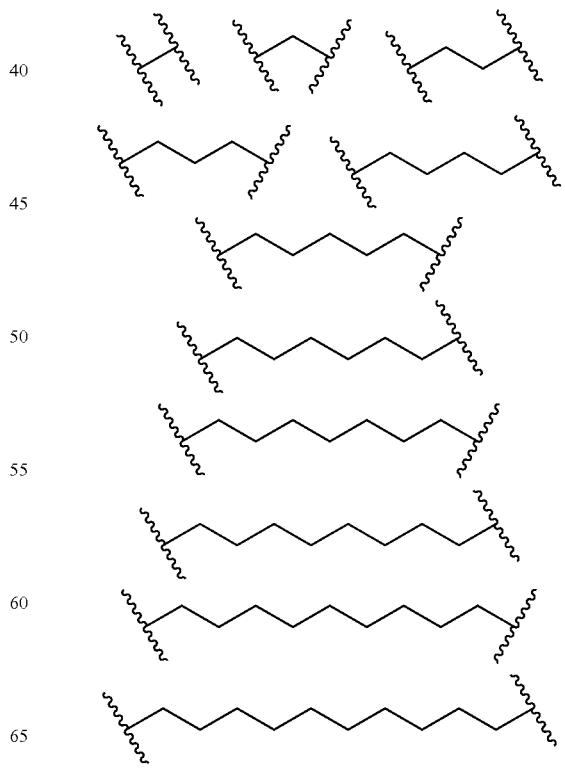

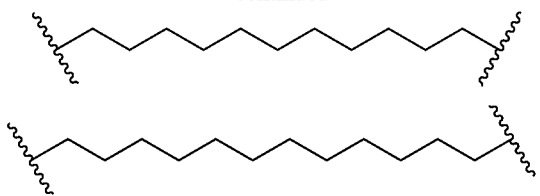

In certain embodiments, A is of one of the formulae:

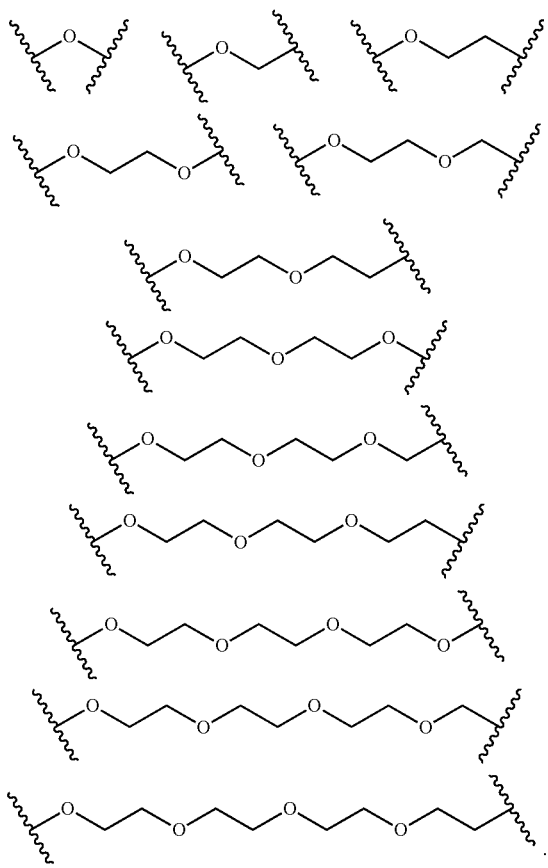

In certain embodiments, A is of one of the formulae:

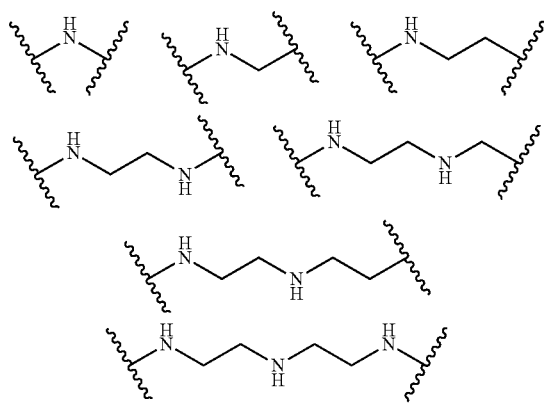

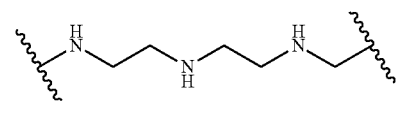

In certain embodiments, A is of the formula:

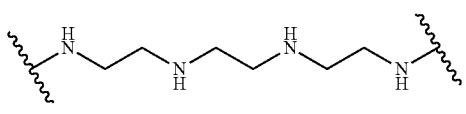

In certain embodiments, A is of the formula:

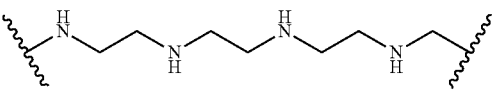

In certain embodiments, $R^1$ is a steroid. In certain embodiments, $R^1$ is a cholesterol. In certain embodiments, $R^1$ is a lipophilic vitamin. In certain embodiments, $R^1$ is a vitamin A. In certain embodiments, $R^1$ is a vitamin E.

In certain embodiments, $R^1$ is of the formula:

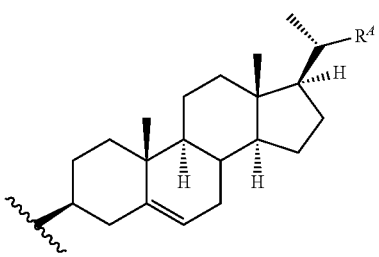

wherein $R^4$ is substituted or unsubstituted, cyclic or acyclic, branched or unbranched aliphatic; or substituted or unsubstituted, cyclic or acyclic, branched or unbranched hetero aliphatic.

In certain embodiments, $R^1$ is of the formula:

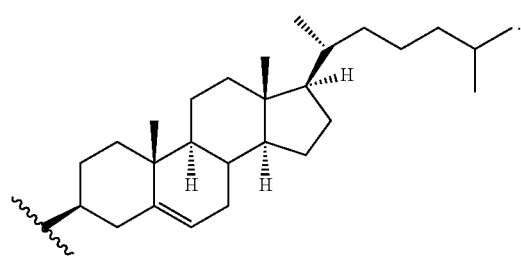

In certain embodiments, $R^1$ is of the formula:

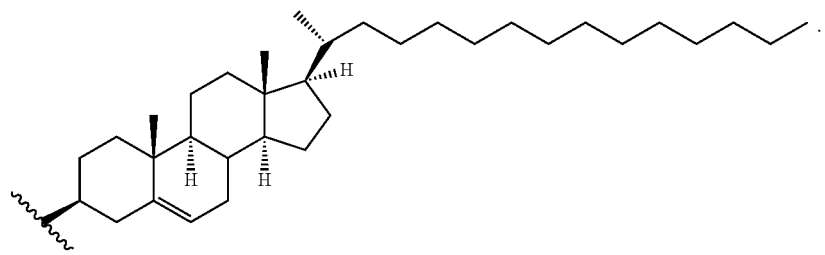

In certain embodiments, $R^1$ is of the formula:

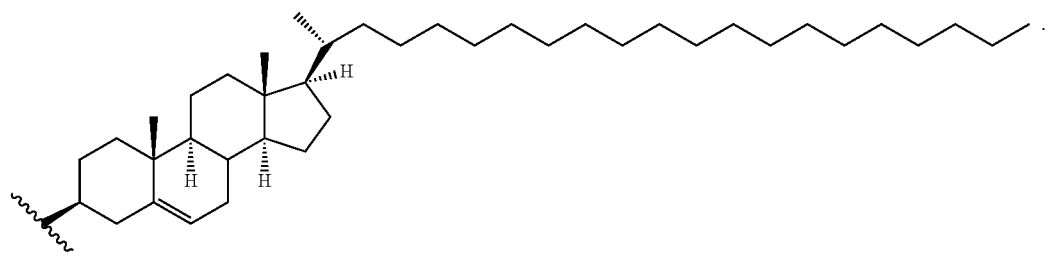

In certain embodiments, $R^1$ is of the formula:

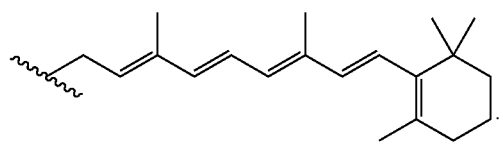 [SMILES: *C/C=C(C)/C=C/C=C(C)/C=C/C1=C(C)CCCC1(C)C]

In certain embodiments, $R^1$ is of the formula:

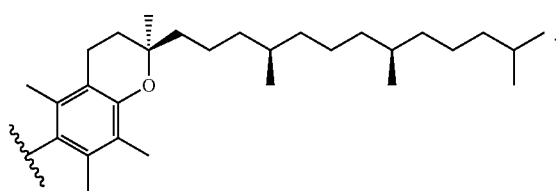 [SMILES: *c1c(C)c(C)c2c(c1C)CC[C@@](C)(CCC[C@H](C)CCC[C@H](C)CCCC(C)C)O2]

In certain embodiments, the nucleic acid molecule is of the formula:

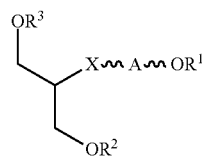

wherein
X is N or CH;
A is a bond; substituted or unsubstituted, cyclic or acyclic, branched or unbranched aliphatic; or substituted or unsubstituted, cyclic or acyclic, branched or unbranched heteroaliphatic;
$R^1$ is a hydrophobic moiety;
$R^2$ is hydrogen; an oxygen-protecting group; cyclic or acyclic, substituted or unsubstituted, branched or unbranched aliphatic; cyclic or acyclic, substituted or unsubstituted, branched or unbranched heteroaliphatic; substituted or unsubstituted, branched or unbranched acyl; substituted or unsubstituted, branched or unbranched aryl; substituted or unsubstituted, branched or unbranched heteroaryl; and
$R^3$ is a nucleic acid.

In certain embodiments, the nucleic acid molecule is of the formula:

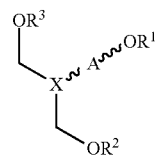

wherein
X is N or CH;
A is a bond; substituted or unsubstituted, cyclic or acyclic, branched or unbranched aliphatic; or substituted or unsubstituted, cyclic or acyclic, branched or unbranched heteroaliphatic;

$R^1$ is a hydrophobic moiety;
$R^2$ is hydrogen; an oxygen-protecting group; cyclic or acyclic, substituted or unsubstituted, branched or unbranched aliphatic; cyclic or acyclic, substituted or unsubstituted, branched or unbranched heteroaliphatic; substituted or unsubstituted, branched or unbranched acyl; substituted or unsubstituted, branched or unbranched aryl; substituted or unsubstituted, branched or unbranched heteroaryl; and
$R^3$ is a nucleic acid.

In certain embodiments, the nucleic acid molecule is of the formula:

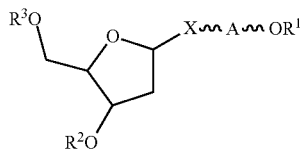

wherein
X is N or CH;
A is a bond; substituted or unsubstituted, cyclic or acyclic, branched or unbranched aliphatic; or substituted or unsubstituted, cyclic or acyclic, branched or unbranched heteroaliphatic;

$R^3$ is a nucleic acid. In certain embodiments, the nucleic acid molecule is of the formula:

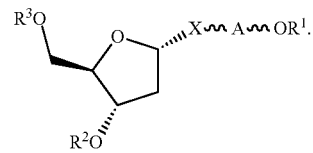

In certain embodiments, the nucleic acid molecule is of the formula:

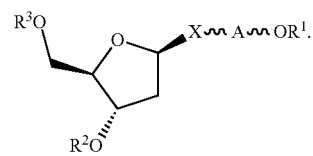

In certain embodiments, the nucleic acid molecule is of the formula:

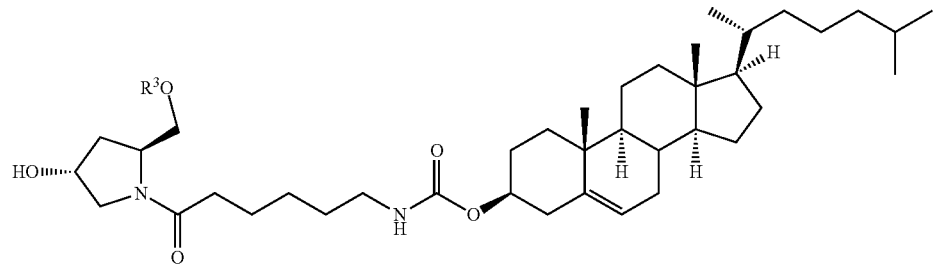

$R^1$ is a hydrophobic moiety;
$R^2$ is hydrogen; an oxygen-protecting group; cyclic or acyclic, substituted or unsubstituted, branched or unbranched aliphatic; cyclic or acyclic, substituted or unsubstituted, branched or unbranched heteroaliphatic; substituted or unsubstituted, branched or unbranched acyl; substituted or unsubstituted, branched or unbranched aryl; substituted or unsubstituted, branched or unbranched heteroaryl; and wherein $R^3$ is a nucleic acid.
In certain embodiments, the nucleic acid molecule is of the formula:

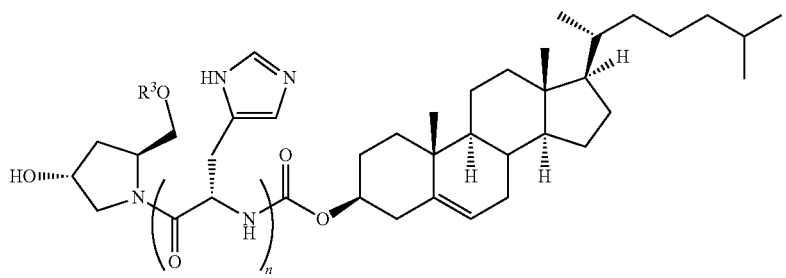

wherein $R^3$ is a nucleic acid; and
n is an integer between 1 and 20, inclusive.

In certain embodiments, the nucleic acid molecule is of the formula:

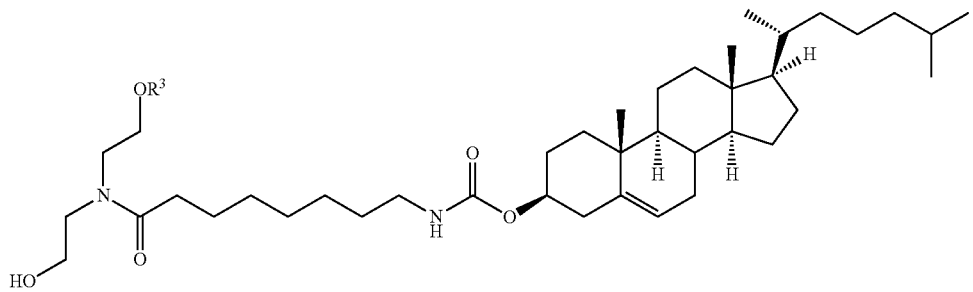

In certain embodiments, the nucleic acid molecule is of the formula:

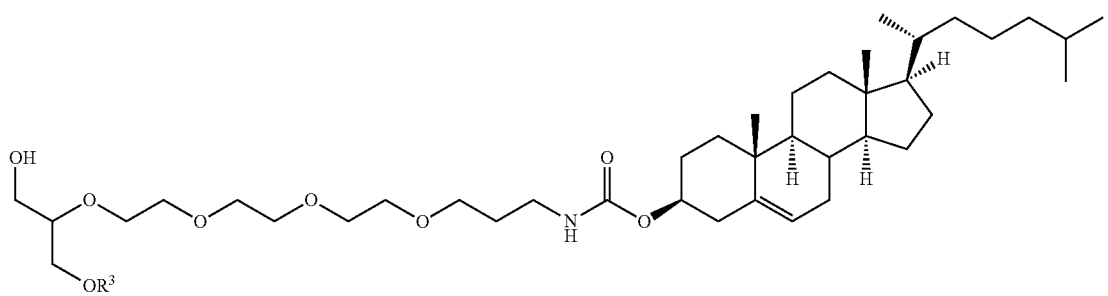

In certain embodiments, the nucleic acid molecule is of the formula:

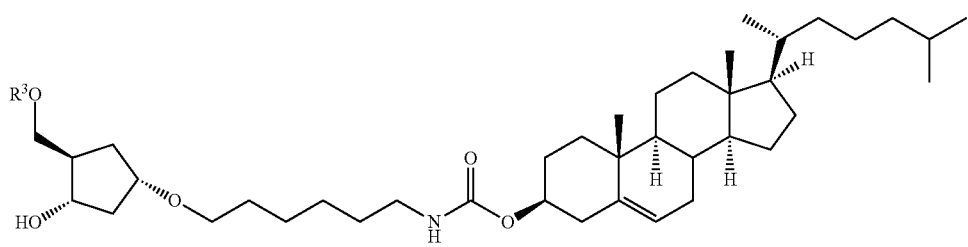

In certain embodiments, the nucleic acid molecule is of the formula:

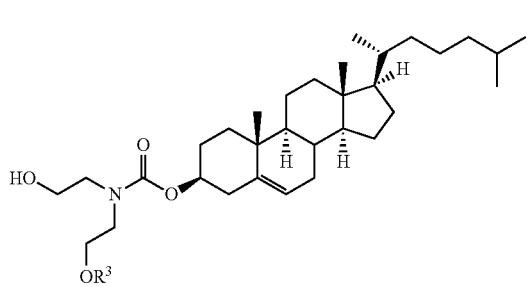

In certain embodiments, the nucleic acid molecule is of the formula:

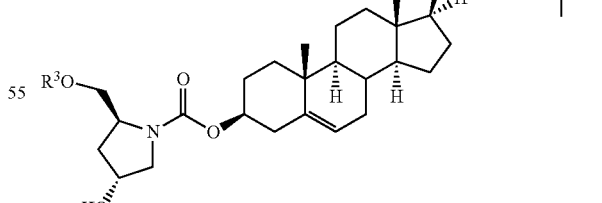

As used herein, the term "linkage" includes a naturally occurring, unmodified phosphodiester moiety (—O—($PO^{2-}$)—O—) that covalently couples adjacent nucleomonomers. As used herein, the term "substitute linkage" includes any analog or derivative of the native phosphodiester group that covalently couples adjacent nucleomonomers. Substitute linkages include phosphodiester analogs, e.g., phosphorothioate, phosphorodithioate, and P-ethyoxyphosphodiester, P-ethoxyphosphodiester, P-alkyloxyphosphotriester, methylphosphonate, and nonphosphorus containing linkages, e.g., acetals and amides. Such substitute linkages are known in the art (e.g., Bjergarde et al. 1991. Nucleic Acids Res. 19:5843; Caruthers et al. 1991. Nucleosides Nucleotides. 10:47). In certain embodiments, non-hydrolizable linkages are preferred, such as phosphorothioate linkages.

In certain embodiments, oligonucleotides of the invention comprise hydrophobicly modified nucleotides or "hydrophobic modifications." As used herein "hydrophobic modifications" refers to bases that are modified such that (1) overall hydrophobicity of the base is significantly increased, and/or (2) the base is still capable of forming close to regular Watson-Crick interaction. Several non-limiting examples of base modifications include 5-position uridine and cytidine modifications such as phenyl, 4-pyridyl, 2-pyridyl, indolyl, and isobutyl, phenyl (C6H5OH); tryptophanyl (C8H6N)CH2CH (NH2)CO), Isobutyl, butyl, aminobenzyl; phenyl; and naphthyl.

Another type of conjugates that can be attached to the end (3' or 5' end), the loop region, or any other parts of the sd-rxRNA might include a sterol, sterol type molecule, peptide, small molecule, protein, etc. In some embodiments, a sd-rxRNA may contain more than one conjugates (same or different chemical nature). In some embodiments, the conjugate is cholesterol.

Another way to increase target gene specificity, or to reduce off-target silencing effect, is to introduce a 2'-modification (such as the 2'-O methyl modification) at a position corresponding to the second 5'-end nucleotide of the guide sequence. This allows the positioning of this 2'-modification in the Dicer-resistant hairpin structure, thus enabling one to design better RNAi constructs with less or no off-target silencing.

In one embodiment, a hairpin polynucleotide of the invention can comprise one nucleic acid portion which is DNA and one nucleic acid portion which is RNA. Antisense (guide) sequences of the invention can be "chimeric oligonucleotides" which comprise an RNA-like and a DNA-like region.

The language "RNase H activating region" includes a region of an oligonucleotide, e.g., a chimeric oligonucleotide, that is capable of recruiting RNase H to cleave the target RNA strand to which the oligonucleotide binds. Typically, the RNase activating region contains a minimal core (of at least about 3-5, typically between about 3-12, more typically, between about 5-12, and more preferably between about 5-10 contiguous nucleomonomers) of DNA or DNA-like nucleomonomers. (See, e.g., U.S. Pat. No. 5,849,902). Preferably, the RNase H activating region comprises about nine contiguous deoxyribose containing nucleomonomers.

The language "non-activating region" includes a region of an antisense sequence, e.g., a chimeric oligonucleotide, that does not recruit or activate RNase H. Preferably, a non-activating region does not comprise phosphorothioate DNA. The oligonucleotides of the invention comprise at least one non-activating region. In one embodiment, the non-activating region can be stabilized against nucleases or can provide specificity for the target by being complementary to the target and forming hydrogen bonds with the target nucleic acid molecule, which is to be bound by the oligonucleotide.

In one embodiment, at least a portion of the contiguous polynucleotides are linked by a substitute linkage, e.g., a phosphorothioate linkage.

In certain embodiments, most or all of the nucleotides beyond the guide sequence (2'-modified or not) are linked by phosphorothioate linkages. Such constructs tend to have improved pharmacokinetics due to their higher affinity for serum proteins. The phosphorothioate linkages in the non-guide sequence portion of the polynucleotide generally do not interfere with guide strand activity, once the latter is loaded into RISC.

Antisense (guide) sequences of the present invention may include "morpholino oligonucleotides." Morpholino oligonucleotides are non-ionic and function by an RNase H-independent mechanism. Each of the 4 genetic bases (Adenine, Cytosine, Guanine, and Thymine/Uracil) of the morpholino oligonucleotides is linked to a 6-membered morpholine ring. Morpholino oligonucleotides are made by joining the 4 different subunit types by, e.g., non-ionic phosphorodiamidate inter-subunit linkages. Morpholino oligonucleotides have many advantages including: complete resistance to nucleases (Antisense & Nucl. Acid Drug Dev. 1996. 6:267); predictable targeting (Biochemica Biophysica Acta. 1999. 1489:141); reliable activity in cells (Antisense & Nucl. Acid Drug Dev. 1997. 7:63); excellent sequence specificity (Antisense & Nucl. Acid Drug Dev. 1997. 7:151); minimal non-antisense activity (Biochemica Biophysica Acta. 1999. 1489:141); and simple osmotic or scrape delivery (Antisense & Nucl. Acid Drug Dev. 1997. 7:291). Morpholino oligonucleotides are also preferred because of their non-toxicity at high doses. A discussion of the preparation of morpholino oligonucleotides can be found in Antisense & Nucl. Acid Drug Dev. 1997. 7:187.

The chemical modifications described herein are believed, based on the data described herein, to promote single stranded polynucleotide loading into the RISC. Single stranded polynucleotides have been shown to be active in loading into RISC and inducing gene silencing. However, the level of activity for single stranded polynucleotides appears to be 2 to 4 orders of magnitude lower when compared to a duplex polynucleotide.

Figure 5:
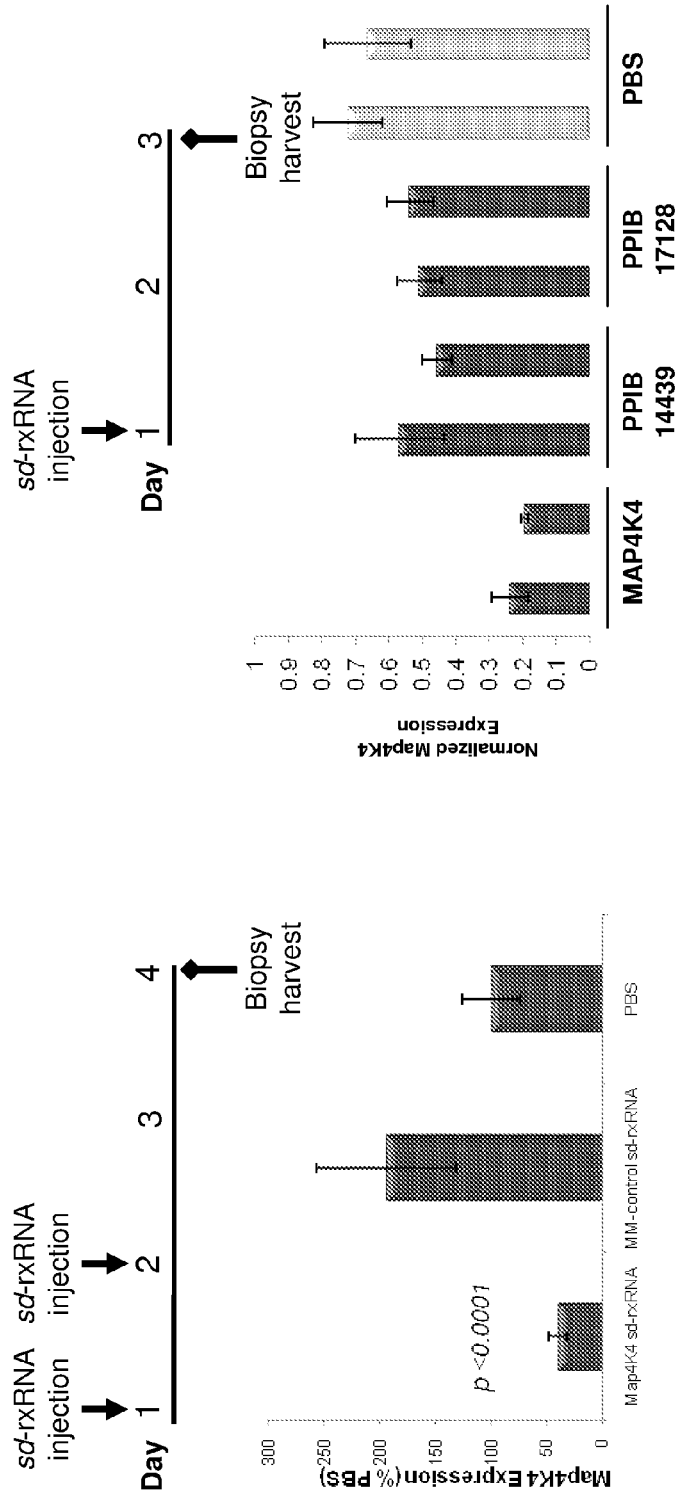
FIG. 5 demonstrates silencing of MAP4K4 following intradermal injection of sd-rxRNA targeting MAP4K4. Normalized expression of MAP4K4 relative to controls is demonstrated.

The present invention provides a description of the chemical modification patterns, which may (a) significantly increase stability of the single stranded polynucleotide (b) promote efficient loading of the polynucleotide into the RISC complex and (c) improve uptake of the single stranded nucleotide by the cell. FIG. 5 provides some non-limiting examples of the chemical modification patterns which may be beneficial for achieving single stranded polynucleotide efficacy inside the cell. The chemical modification patterns may include combination of ribose, backbone, hydrophobic nucleoside and conjugate type of modifications. In addition, in some of the embodiments, the 5' end of the single polynucleotide may be chemically phosphorylated.

Figure 6:
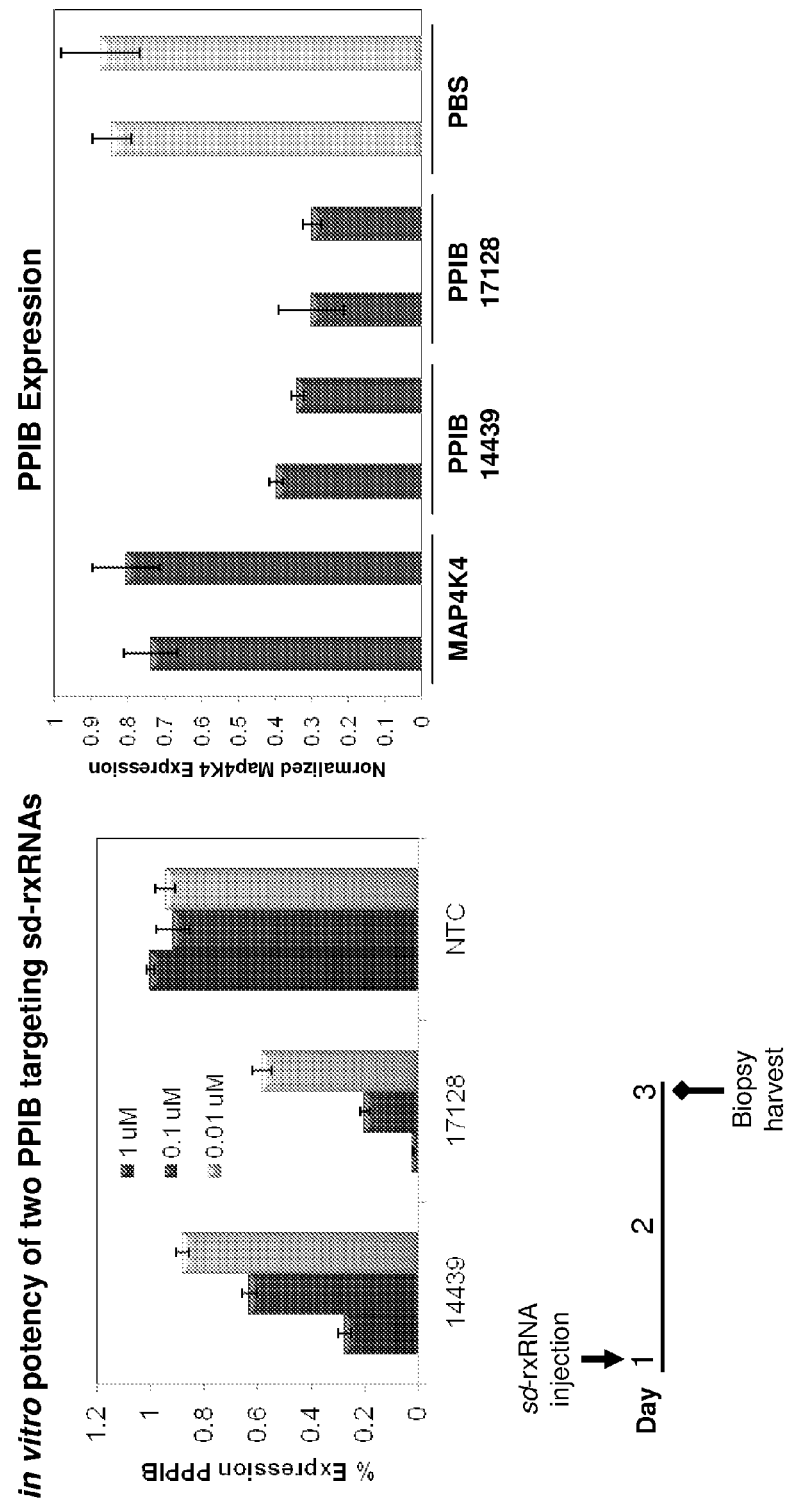
FIG. 6 demonstrates silencing of PPIB following intradermal injection of sd-rxRNA targeting PPIB. Normalized expression of PPIB relative to controls is demonstrated.

In yet another embodiment, the present invention provides a description of the chemical modifications patterns, which improve functionality of RISC inhibiting polynucleotides. Single stranded polynucleotides have been shown to inhibit activity of a preloaded RISC complex through the substrate competition mechanism. For these types of molecules, conventionally called antagomers, the activity usually requires high concentration and in vivo delivery is not very effective. The present invention provides a description of the chemical modification patterns, which may (a) significantly increase stability of the single stranded polynucleotide (b) promote efficient recognition of the polynucleotide by the RISC as a substrate and/or (c) improve uptake of the single stranded nucleotide by the cell. FIG. 6 provides some non-limiting examples of the chemical modification patterns that may be beneficial for achieving single stranded polynucleotide efficacy inside the cell. The chemical modification patterns may include combination of ribose, backbone, hydrophobic nucleoside and conjugate type of modifications.

The modifications provided by the present invention are applicable to all polynucleotides. This includes single stranded RISC entering polynucleotides, single stranded RISC inhibiting polynucleotides, conventional duplexed polynucleotides of variable length (15-40 bp), asymmetric duplexed polynucleotides, and the like. Polynucleotides may be modified with wide variety of chemical modification patterns, including 5' end, ribose, backbone and hydrophobic nucleoside modifications.

Synthesis

Oligonucleotides of the invention can be synthesized by any method known in the art, e.g., using enzymatic synthesis and/or chemical synthesis. The oligonucleotides can be synthesized in vitro (e.g., using enzymatic synthesis and chemical synthesis) or in vivo (using recombinant DNA technology well known in the art).

In a preferred embodiment, chemical synthesis is used for modified polynucleotides. Chemical synthesis of linear oligonucleotides is well known in the art and can be achieved by solution or solid phase techniques. Preferably, synthesis is by solid phase methods. Oligonucleotides can be made by any of several different synthetic procedures including the phosphoramidite, phosphite triester, H-phosphonate, and phosphotriester methods, typically by automated synthesis methods.

Oligonucleotide synthesis protocols are well known in the art and can be found, e.g., in U.S. Pat. No. 5,830,653; WO 98/13526; Stec et al. 1984. *J. Am. Chem. Soc.* 106:6077; Stec et al. 1985. *J. Org. Chem.* 50:3908; Stec et al. J. Chromatog. 1985. 326:263; LaPlanche et al. 1986. *Nucl. Acid. Res.* 1986. 14:9081; Fasman G. D., 1989. Practical Handbook of Biochemistry and Molecular Biology. 1989. CRC Press, Boca Raton, Fla.; Lamone. 1993. *Biochem. Soc. Trans.* 21:1; U.S. Pat. Nos. 5,013,830; 5,214,135; 5,525,719; Kawasaki et al. 1993. *J. Med. Chem.* 36:831; WO 92/03568; U.S. Pat. Nos. 5,276,019; and 5,264,423.

The synthesis method selected can depend on the length of the desired oligonucleotide and such choice is within the skill of the ordinary artisan. For example, the phosphoramidite and phosphite triester method can produce oligonucleotides having 175 or more nucleotides, while the H-phosphonate method works well for oligonucleotides of less than 100 nucleotides. If modified bases are incorporated into the oligonucleotide, and particularly if modified phosphodiester linkages are used, then the synthetic procedures are altered as needed according to known procedures. In this regard, Uhlmann et al. (1990, *Chemical Reviews* 90:543-584) provide references and outline procedures for making oligonucleotides with modified bases and modified phosphodiester linkages. Other exemplary methods for making oligonucleotides are taught in Sonveaux. 1994. "Protecting Groups in Oligonucleotide Synthesis"; Agrawal. *Methods in Molecular Biology* 26:1. Exemplary synthesis methods are also taught in "Oligonucleotide Synthesis—A Practical Approach" (Gait, M. J. IRL Press at Oxford University Press. 1984). Moreover, linear oligonucleotides of defined sequence, including some sequences with modified nucleotides, are readily available from several commercial sources.

The oligonucleotides may be purified by polyacrylamide gel electrophoresis, or by any of a number of chromatographic methods, including gel chromatography and high pressure liquid chromatography. To confirm a nucleotide sequence, especially unmodified nucleotide sequences, oligonucleotides may be subjected to DNA sequencing by any of the known procedures, including Maxam and Gilbert sequencing, Sanger sequencing, capillary electrophoresis sequencing, the wandering spot sequencing procedure or by using selective chemical degradation of oligonucleotides bound to Hybond paper. Sequences of short oligonucleotides can also be analyzed by laser desorption mass spectroscopy or by fast atom bombardment (McNeal, et al., 1982, *J. Am. Chem. Soc.* 104:976; Viari, et al., 1987, *Biomed. Environ. Mass Spectrom.* 14:83; Grotjahn et al., 1982, *Nuc. Acid Res.* 10:4671). Sequencing methods are also available for RNA oligonucleotides.

The quality of oligonucleotides synthesized can be verified by testing the oligonucleotide by capillary electrophoresis and denaturing strong anion HPLC (SAX-HPLC) using, e.g., the method of Bergot and Egan. 1992. *J. Chrom.* 599:35.

Other exemplary synthesis techniques are well known in the art (see, e.g., Sambrook et al., Molecular Cloning: a Laboratory Manual, Second Edition (1989); DNA Cloning, Volumes I and II (D N Glover Ed. 1985); Oligonucleotide Synthesis (M J Gait Ed, 1984; Nucleic Acid Hybridisation (B D Hames and S J Higgins eds. 1984); A Practical Guide to Molecular Cloning (1984); or the series, Methods in Enzymology (Academic Press, Inc.)).

In certain embodiments, the subject RNAi constructs or at least portions thereof are transcribed from expression vectors encoding the subject constructs. Any art recognized vectors may be use for this purpose. The transcribed RNAi constructs may be isolated and purified, before desired modifications (such as replacing an unmodified sense strand with a modified one, etc.) are carried out.

Delivery/Carrier

Uptake of Oligonucleotides by Cells

Oligonucleotides and oligonucleotide compositions are contacted with (i.e., brought into contact with, also referred to herein as administered or delivered to) and taken up by one or more cells or a cell lysate. The term "cells" includes prokaryotic and eukaryotic cells, preferably vertebrate cells, and, more preferably, mammalian cells. In a preferred embodiment, the oligonucleotide compositions of the invention are contacted with human cells.

Oligonucleotide compositions of the invention can be contacted with cells in vitro, e.g., in a test tube or culture dish, (and may or may not be introduced into a subject) or in vivo, e.g., in a subject such as a mammalian subject. Oligonucleotides are taken up by cells at a slow rate by endocytosis, but endocytosed oligonucleotides are generally sequestered and not available, e.g., for hybridization to a target nucleic acid molecule. In one embodiment, cellular uptake can be facilitated by electroporation or calcium phosphate precipitation. However, these procedures are only useful for in vitro or ex vivo embodiments, are not convenient and, in some cases, are associated with cell toxicity.

In another embodiment, delivery of oligonucleotides into cells can be enhanced by suitable art recognized methods including calcium phosphate, DMSO, glycerol or dextran, electroporation, or by transfection, e.g., using cationic, anionic, or neutral lipid compositions or liposomes using methods known in the art (see e.g., WO 90/14074; WO 91/16024; WO 91/17424; U.S. Pat. No. 4,897,355; Bergan et al. 1993. *Nucleic Acids Research.* 21:3567). Enhanced delivery of oligonucleotides can also be mediated by the use of vectors (See e.g., Shi, Y. 2003. Trends Genet 2003 Jan. 19:9; Reichhart J M et al. Genesis. 2002. 34(1-2):1604, Yu et al. 2002. Proc. Natl. Acad Sci. USA 99:6047; Sui et al. 2002. Proc. Natl. Acad Sci. USA 99:5515) viruses, polyamine or polycation conjugates using compounds such as polylysine, protamine, or Ni, N12-bis(ethyl)spermine (see, e.g., Bartzatt, R. et al. 1989. *Biotechnol. Appl. Biochem.* 11:133; Wagner E. et al. 1992. *Proc. Natl. Acad. Sci.* 88:4255).

In certain embodiments, the sd-rxRNA of the invention may be delivered by using various beta-glucan containing particles, referred to as GeRPs (glucan encapsulated RNA loaded particle), described in, and incorporated by reference from, U.S. Provisional Application No. 61/310,611, filed on Mar. 4, 2010 and entitled "Formulations and Methods for Targeted Delivery to Phagocyte Cells." Such particles are also described in, and incorporated by reference from US Patent Publications US 2005/0281781 A1, and US 2010/0040656, and in PCT publications WO 2006/007372, and WO 2007/050643. The sd-rxRNA molecule may be hydrophobically modified and optionally may be associated with a lipid and/or amphiphilic peptide. In certain embodiments, the beta-glucan particle is derived from yeast. In certain embodiments, the payload trapping molecule is a polymer, such as those with a molecular weight of at least about 1000 Da, 10,000 Da, 50,000 Da, 100 kDa, 500 kDa, etc. Preferred polymers include (without limitation) cationic polymers, chitosans, or PEI (polyethylenimine), etc.

Glucan particles can be derived from insoluble components of fungal cell walls such as yeast cell walls. In some embodiments, the yeast is Baker's yeast. Yeast-derived glucan molecules can include one or more of β-(1,3)-Glucan, β-(1,6)-Glucan, mannan and chitin. In some embodiments, a glucan particle comprises a hollow yeast cell wall whereby the particle maintains a three dimensional structure resembling a cell, within which it can complex with or encapsulate a molecule such as an RNA molecule. Some of the advantages associated with the use of yeast cell wall particles are availability of the components, their biodegradable nature, and their ability to be targeted to phagocytic cells.

In some embodiments, glucan particles can be prepared by extraction of insoluble components from cell walls, for example by extracting Baker's yeast (Fleischmann's) with 1M NaOH/pH 4.0 H2O, followed by washing and drying. Methods of preparing yeast cell wall particles are discussed in, and incorporated by reference from U.S. Pat. Nos. 4,810,646, 4,992,540, 5,082,936, 5,028,703, 5,032,401, 5,322,841, 5,401,727, 5,504,079, 5,607,677, 5,968,811, 6,242,594, 6,444,448, 6,476,003, US Patent Publications 2003/0216346, 2004/0014715 and 2010/0040656, and PCT published application WO02/12348.

Protocols for preparing glucan particles are also described in, and incorporated by reference from, the following references: Soto and Ostroff (2008), "Characterization of multilayered nanoparticles encapsulated in yeast cell wall particles for DNA delivery." *Bioconjug Chem* 19(4):840-8; Soto and Ostroff (2007), "Oral Macrophage Mediated Gene Delivery System," *Nanotech*, Volume 2, Chapter 5 ("Drug Delivery"), pages 378-381; and Li et al. (2007), "Yeast glucan particles activate murine resident macrophages to secrete proinflammatory cytokines via MyD88- and Syk kinase-dependent pathways." *Clinical Immunology* 124(2):170-181.

Glucan containing particles such as yeast cell wall particles can also be obtained commercially. Several non-limiting examples include: Nutricell MOS 55 from Biorigin (Sao Paolo, Brazil), SAF-Mannan (SAF Agri, Minneapolis, Minn.), Nutrex (Sensient Technologies, Milwaukee, Wis.), alkali-extracted particles such as those produced by Nutricepts (Nutricepts Inc., Burnsville, Minn.) and ASA Biotech, acid-extracted WGP particles from Biopolymer Engineering, and organic solvent-extracted particles such as Adjuvax™ from Alpha-beta Technology, Inc. (Worcester, Mass.) and microparticulate glucan from Novogen (Stamford, Conn.).

Glucan particles such as yeast cell wall particles can have varying levels of purity depending on the method of production and/or extraction. In some instances, particles are alkali-extracted, acid-extracted or organic solvent-extracted to remove intracellular components and/or the outer mannoprotein layer of the cell wall. Such protocols can produce particles that have a glucan (w/w) content in the range of 50%-90%. In some instances, a particle of lower purity, meaning lower glucan w/w content may be preferred, while in other embodiments, a particle of higher purity, meaning higher glucan w/w content may be preferred.

Glucan particles, such as yeast cell wall particles, can have a natural lipid content. For example, the particles can contain 1%, 2%, 3%, 4%, 5%, 6%, 7%, 8%, 9%, 10%, 11%, 12%, 13%, 14%, 15%, 16%, 17%, 18%, 19%, 20% or more than 20% w/w lipid. In the Examples section, the effectiveness of two glucan particle batches are tested: YGP SAF and YGP SAF+L (containing natural lipids). In some instances, the presence of natural lipids may assist in complexation or capture of RNA molecules.

Glucan containing particles typically have a diameter of approximately 2-4 microns, although particles with a diameter of less than 2 microns or greater than 4 microns are also compatible with aspects of the invention.

The RNA molecule(s) to be delivered are complexed or "trapped" within the shell of the glucan particle. The shell or RNA component of the particle can be labeled for visualization, as described in, and incorporated by reference from, Soto and Ostroff (2008) *Bioconjug Chem* 19:840. Methods of loading GeRPs are discussed further below.

The optimal protocol for uptake of oligonucleotides will depend upon a number of factors, the most crucial being the type of cells that are being used. Other factors that are important in uptake include, but are not limited to, the nature and concentration of the oligonucleotide, the confluence of the cells, the type of culture the cells are in (e.g., a suspension culture or plated) and the type of media in which the cells are grown.

Encapsulating Agents

Encapsulating agents entrap oligonucleotides within vesicles. In another embodiment of the invention, an oligonucleotide may be associated with a carrier or vehicle, e.g., liposomes or micelles, although other carriers could be used, as would be appreciated by one skilled in the art. Liposomes are vesicles made of a lipid bilayer having a structure similar to biological membranes. Such carriers are used to facilitate the cellular uptake or targeting of the oligonucleotide, or improve the oligonucleotides pharmacokinetic or toxicological properties.

For example, the oligonucleotides of the present invention may also be administered encapsulated in liposomes, pharmaceutical compositions wherein the active ingredient is contained either dispersed or variously present in corpuscles consisting of aqueous concentric layers adherent to lipidic layers. The oligonucleotides, depending upon solubility, may be present both in the aqueous layer and in the lipidic layer, or in what is generally termed a liposomic suspension. The hydrophobic layer, generally but not exclusively, comprises phopholipids such as lecithin and sphingomyelin, steroids such as cholesterol, more or less ionic surfactants such as diacetylphosphate, stearylamine, or phosphatidic acid, or other materials of a hydrophobic nature. The diameters of the liposomes generally range from about 15 nm to about 5 microns.

The use of liposomes as drug delivery vehicles offers several advantages. Liposomes increase intracellular stability, increase uptake efficiency and improve biological activity.

Liposomes are hollow spherical vesicles composed of lipids arranged in a similar fashion as those lipids which make up the cell membrane. They have an internal aqueous space for entrapping water soluble compounds and range in size from 0.05 to several microns in diameter. Several studies have shown that liposomes can deliver nucleic acids to cells and that the nucleic acids remain biologically active. For example, a lipid delivery vehicle originally designed as a research tool, such as Lipofectin or LIPOFECTAMINE™ 2000, can deliver intact nucleic acid molecules to cells.

Specific advantages of using liposomes include the following: they are non-toxic and biodegradable in composition; they display long circulation half-lives; and recognition molecules can be readily attached to their surface for targeting to tissues. Finally, cost-effective manufacture of liposome-based pharmaceuticals, either in a liquid suspension or lyophilized product, has demonstrated the viability of this technology as an acceptable drug delivery system.

In some aspects, formulations associated with the invention might be selected for a class of naturally occurring or chemically synthesized or modified saturated and unsaturated fatty acid residues. Fatty acids might exist in a form of triglycerides, diglycerides or individual fatty acids. In another embodiment, the use of well-validated mixtures of fatty acids and/or fat emulsions currently used in pharmacology for parenteral nutrition may be utilized.

Liposome based formulations are widely used for oligonucleotide delivery. However, most of commercially available lipid or liposome formulations contain at least one positively charged lipid (cationic lipids). The presence of this positively charged lipid is believed to be essential for obtaining a high degree of oligonucleotide loading and for enhancing liposome fusogenic properties. Several methods have been performed and published to identify optimal positively charged lipid chemistries. However, the commercially available liposome formulations containing cationic lipids are characterized by a high level of toxicity. In vivo limited therapeutic indexes have revealed that liposome formulations containing positive charged lipids are associated with toxicity (i.e. elevation in liver enzymes) at concentrations only slightly higher than concentration required to achieve RNA silencing.

Nucleic acids associated with the invention can be hydrophobically modified and can be encompassed within neutral nanotransporters. Further description of neutral nanotransporters is incorporated by reference from PCT Application PCT/US2009/005251, filed on Sep. 22, 2009, and entitled "Neutral Nanotransporters." Such particles enable quantitative oligonucleotide incorporation into non-charged lipid mixtures. The lack of toxic levels of cationic lipids in such neutral nanotransporter compositions is an important feature.

As demonstrated in PCT/US2009/005251, oligonucleotides can effectively be incorporated into a lipid mixture that is free of cationic lipids and such a composition can effectively deliver a therapeutic oligonucleotide to a cell in a manner that it is functional. For example, a high level of activity was observed when the fatty mixture was composed of a phosphatidylcholine base fatty acid and a sterol such as a cholesterol. For instance, one preferred formulation of neutral fatty mixture is composed of at least 20% of DOPC or DSPC and at least 20% of sterol such as cholesterol. Even as low as 1:5 lipid to oligonucleotide ratio was shown to be sufficient to get complete encapsulation of the oligonucleotide in a non charged formulation.

The neutral nanotransporters compositions enable efficient loading of oligonucleotide into neutral fat formulation. The composition includes an oligonucleotide that is modified in a manner such that the hydrophobicity of the molecule is increased (for example a hydrophobic molecule is attached (covalently or no-covalently) to a hydrophobic molecule on the oligonucleotide terminus or a non-terminal nucleotide, base, sugar, or backbone), the modified oligonucleotide being mixed with a neutral fat formulation (for example containing at least 25% of cholesterol and 25% of DOPC or analogs thereof). A cargo molecule, such as another lipid can also be included in the composition. This composition, where part of the formulation is build into the oligonucleotide itself, enables efficient encapsulation of oligonucleotide in neutral lipid particles.

In some aspects, stable particles ranging in size from 50 to 140 nm can be formed upon complexing of hydrophobic oligonucleotides with preferred formulations. It is interesting to mention that the formulation by itself typically does not form small particles, but rather, forms agglomerates, which are transformed into stable 50-120 nm particles upon addition of the hydrophobic modified oligonucleotide.

The neutral nanotransporter compositions of the invention include a hydrophobic modified polynucleotide, a neutral fatty mixture, and optionally a cargo molecule. A "hydrophobic modified polynucleotide" as used herein is a polynucleotide of the invention (i.e. sd-rxRNA) that has at least one modification that renders the polynucleotide more hydrophobic than the polynucleotide was prior to modification. The modification may be achieved by attaching (covalently or non-covalently) a hydrophobic molecule to the polynucleotide. In some instances the hydrophobic molecule is or includes a lipophilic group.

The term "lipophilic group" means a group that has a higher affinity for lipids than its affinity for water. Examples of lipophilic groups include, but are not limited to, cholesterol, a cholesteryl or modified cholesteryl residue, adamantine, dihydrotesterone, long chain alkyl, long chain alkenyl, long chain alkynyl, olely-lithocholic, cholenic, oleoyl-cholenic, palmityl, heptadecyl, myrisityl, bile acids, cholic acid or taurocholic acid, deoxycholate, oleyl litocholic acid, oleoyl cholenic acid, glycolipids, phospholipids, sphingolipids, isoprenoids, such as steroids, vitamins, such as vitamin E, fatty acids either saturated or unsaturated, fatty acid esters, such as triglycerides, pyrenes, porphyrines, Texaphyrine, adamantane, acridines, biotin, coumarin, fluorescein, rhodamine, Texas-Red, digoxygenin, dimethoxytrityl, t-butyldimethylsilyl, t-butyldiphenylsilyl, cyanine dyes (e.g. Cy3 or Cy5), Hoechst 33258 dye, psoralen, or ibuprofen. The cholesterol moiety may be reduced (e.g. as in cholestan) or may be substituted (e.g. by halogen). A combination of different lipophilic groups in one molecule is also possible.

The hydrophobic molecule may be attached at various positions of the polynucleotide. As described above, the hydrophobic molecule may be linked to the terminal residue of the polynucleotide such as the 3' of 5'-end of the polynucleotide. Alternatively, it may be linked to an internal nucleotide or a nucleotide on a branch of the polynucleotide. The hydrophobic molecule may be attached, for instance to a 2'-position of the nucleotide. The hydrophobic molecule may also be linked to the heterocyclic base, the sugar or the backbone of a nucleotide of the polynucleotide.

The hydrophobic molecule may be connected to the polynucleotide by a linker moiety. Optionally the linker moiety is a non-nucleotidic linker moiety. Non-nucleotidic linkers are e.g. abasic residues (dSpacer), oligoethyleneglycol, such as triethyleneglycol (spacer 9) or hexaethylenegylcol (spacer 18), or alkane-diol, such as butanediol. The spacer units are preferably linked by phosphodiester or phosphorothioate bonds. The linker units may appear just once in the molecule or may be incorporated several times, e.g. via phosphodiester, phosphorothioate, methylphosphonate, or amide linkages.

Typical conjugation protocols involve the synthesis of polynucleotides bearing an aminolinker at one or more positions of the sequence, however, a linker is not required. The amino group is then reacted with the molecule being conjugated using appropriate coupling or activating reagents. The conjugation reaction may be performed either with the polynucleotide still bound to a solid support or following cleavage of the polynucleotide in solution phase. Purification of the modified polynucleotide by HPLC typically results in a pure material.

In some embodiments the hydrophobic molecule is a sterol type conjugate, a PhytoSterol conjugate, cholesterol conjugate, sterol type conjugate with altered side chain length, fatty acid conjugate, any other hydrophobic group conjugate, and/or hydrophobic modifications of the internal nucleoside, which provide sufficient hydrophobicity to be incorporated into micelles.

For purposes of the present invention, the term "sterols", refers or steroid alcohols are a subgroup of steroids with a hydroxyl group at the 3-position of the A-ring. They are amphipathic lipids synthesized from acetyl-coenzyme A via the HMG-CoA reductase pathway. The overall molecule is quite flat. The hydroxyl group on the A ring is polar. The rest of the aliphatic chain is non-polar. Usually sterols are considered to have an 8 carbon chain at position 17.

For purposes of the present invention, the term "sterol type molecules", refers to steroid alcohols, which are similar in structure to sterols. The main difference is the structure of the ring and number of carbons in a position 21 attached side chain.

For purposes of the present invention, the term "PhytoSterols" (also called plant sterols) are a group of steroid alcohols, phytochemicals naturally occurring in plants. There are more then 200 different known PhytoSterols For purposes of the present invention, the term "Sterol side chain" refers to a chemical composition of a side chain attached at the position 17 of sterol-type molecule. In a standard definition sterols are limited to a 4 ring structure carrying a 8 carbon chain at position 17. In this invention, the sterol type molecules with side chain longer and shorter than conventional are described. The side chain may branched or contain double back bones.

Thus, sterols useful in the invention, for example, include cholesterols, as well as unique sterols in which position 17 has attached side chain of 2-7 or longer then 9 carbons. In a particular embodiment, the length of the polycarbon tail is varied between 5 and 9 carbons. Such conjugates may have significantly better in vivo efficacy, in particular delivery to liver. These types of molecules are expected to work at concentrations 5 to 9 fold lower then oligonucleotides conjugated to conventional cholesterols.

Alternatively the polynucleotide may be bound to a protein, peptide or positively charged chemical that functions as the hydrophobic molecule. The proteins may be selected from the group consisting of protamine, dsRNA binding domain, and arginine rich peptides. Exemplary positively charged chemicals include spermine, spermidine, cadaverine, and putrescine.

In another embodiment hydrophobic molecule conjugates may demonstrate even higher efficacy when it is combined with optimal chemical modification patterns of the polynucleotide (as described herein in detail), containing but not limited to hydrophobic modifications, phosphorothioate modifications, and 2' ribo modifications.

In another embodiment the sterol type molecule may be a naturally occurring PhytoSterols. The polycarbon chain may be longer than 9 and may be linear, branched and/or contain double bonds. Some PhytoSterol containing polynucleotide conjugates may be significantly more potent and active in delivery of polynucleotides to various tissues. Some PhytoSterols may demonstrate tissue preference and thus be used as a way to delivery RNAi specifically to particular tissues.

The hydrophobic modified polynucleotide is mixed with a neutral fatty mixture to form a micelle. The neutral fatty acid mixture is a mixture of fats that has a net neutral or slightly net negative charge at or around physiological pH that can form a micelle with the hydrophobic modified polynucleotide. For purposes of the present invention, the term "micelle" refers to a small nanoparticle formed by a mixture of non charged fatty acids and phospholipids. The neutral fatty mixture may include cationic lipids as long as they are present in an amount that does not cause toxicity. In preferred embodiments the neutral fatty mixture is free of cationic lipids. A mixture that is free of cationic lipids is one that has less than 1% and preferably 0% of the total lipid being cationic lipid. The term "cationic lipid" includes lipids and synthetic lipids having a net positive charge at or around physiological pH. The term "anionic lipid" includes lipids and synthetic lipids having a net negative charge at or around physiological pH.

The neutral fats bind to the oligonucleotides of the invention by a strong but non-covalent attraction (e.g., an electrostatic, van der Waals, pi-stacking, etc. interaction).

The neutral fat mixture may include formulations selected from a class of naturally occurring or chemically synthesized or modified saturated and unsaturated fatty acid residues. Fatty acids might exist in a form of triglycerides, diglycerides or individual fatty acids. In another embodiment the use of well-validated mixtures of fatty acids and/or fat emulsions currently used in pharmacology for parenteral nutrition may be utilized.

The neutral fatty mixture is preferably a mixture of a choline based fatty acid and a sterol. Choline based fatty acids include for instance, synthetic phosphocholine derivatives such as DDPC, DLPC, DMPC, DPPC, DSPC, DOPC, POPC, and DEPC. DOPC (chemical registry number 4235-95-4) is dioleoylphosphatidylcholine (also known as dielaidoylphosphatidylcholine, dioleoyl-PC, dioleoylphosphocholine, dioleoyl-sn-glycero-3-phosphocholine, dioleylphosphatidylcholine). DSPC (chemical registry number 816-94-4) is distearoylphosphatidylcholine (also known as 1,2-Distearoyl-sn-Glycero-3-phosphocholine).

The sterol in the neutral fatty mixture may be for instance cholesterol. The neutral fatty mixture may be made up completely of a choline based fatty acid and a sterol or it may optionally include a cargo molecule. For instance, the neutral fatty mixture may have at least 20% or 25% fatty acid and 20% or 25% sterol.

For purposes of the present invention, the term "Fatty acids" relates to conventional description of fatty acid. They may exist as individual entities or in a form of two- and triglycerides. For purposes of the present invention, the term "fat emulsions" refers to safe fat formulations given intravenously to subjects who are unable to get enough fat in their diet. It is an emulsion of soy bean oil (or other naturally occurring oils) and egg phospholipids. Fat emulsions are being used for formulation of some insoluble anesthetics. In this disclosure, fat emulsions might be part of commercially available preparations like Intralipid, Liposyn, Nutrilipid, modified commercial preparations, where they are enriched with particular fatty acids or fully de novo-formulated combinations of fatty acids and phospholipids.

In one embodiment, the cells to be contacted with an oligonucleotide composition of the invention are contacted with a mixture comprising the oligonucleotide and a mixture comprising a lipid, e.g., one of the lipids or lipid compositions described supra for between about 12 hours to about 24 hours. In another embodiment, the cells to be contacted with an oligonucleotide composition are contacted with a mixture comprising the oligonucleotide and a mixture comprising a lipid, e.g., one of the lipids or lipid compositions described supra for between about 1 and about five days. In one embodiment, the cells are contacted with a mixture comprising a lipid and the oligonucleotide for between about three days to as long as about 30 days. In another embodiment, a mixture comprising a lipid is left in contact with the cells for at least about five to about 20 days. In another embodiment, a mixture comprising a lipid is left in contact with the cells for at least about seven to about 15 days.

50%-60% of the formulation can optionally be any other lipid or molecule. Such a lipid or molecule is referred to herein as a cargo lipid or cargo molecule. Cargo molecules include but are not limited to intralipid, small molecules, fusogenic peptides or lipids or other small molecules might be added to alter cellular uptake, endosomal release or tissue distribution properties. The ability to tolerate cargo molecules is important for modulation of properties of these particles, if such properties are desirable. For instance the presence of some tissue specific metabolites might drastically alter tissue distribution profiles. For example use of Intralipid type formulation enriched in shorter or longer fatty chains with various degrees of saturation affects tissue distribution profiles of these type of formulations (and their loads).

An example of a cargo lipid useful according to the invention is a fusogenic lipid. For instance, the zwiterionic lipid DOPE (chemical registry number 4004-5-1, 1,2-Dioleoyl-sn-Glycero-3-phosphoethanolamine) is a preferred cargo lipid.

Intralipid may be comprised of the following composition: 1 000 mL contain: purified soybean oil 90 g, purified egg phospholipids 12 g, glycerol anhydrous 22 g, water for injection q.s. ad 1 000 mL. pH is adjusted with sodium hydroxide to pH approximately 8. Energy content/L: 4.6 MJ (190 kcal). Osmolality (approx.): 300 mOsm/kg water. In another embodiment fat emulsion is Liposyn that contains 5% safflower oil, 5% soybean oil, up to 1.2% egg phosphatides added as an emulsifier and 2.5% glycerin in water for injection. It may also contain sodium hydroxide for pH adjustment. pH 8.0 (6.0-9.0). Liposyn has an osmolarity of 276 m Osmol/liter (actual).

Variation in the identity, amounts and ratios of cargo lipids affects the cellular uptake and tissue distribution characteristics of these compounds. For example, the length of lipid tails and level of saturability will affect differential uptake to liver, lung, fat and cardiomyocytes. Addition of special hydrophobic molecules like vitamins or different forms of sterols can favor distribution to special tissues which are involved in the metabolism of particular compounds. Complexes are formed at different oligonucleotide concentrations, with higher concentrations favoring more efficient complex formation.

In another embodiment, the fat emulsion is based on a mixture of lipids. Such lipids may include natural compounds, chemically synthesized compounds, purified fatty acids or any other lipids. In yet another embodiment the composition of fat emulsion is entirely artificial. In a particular embodiment, the fat emulsion is more then 70% linoleic acid. In yet another particular embodiment the fat emulsion is at least 1% of cardiolipin. Linoleic acid (LA) is an unsaturated omega-6 fatty acid. It is a colorless liquid made of a carboxylic acid with an 18-carbon chain and two cis double bonds.

Figure 12:
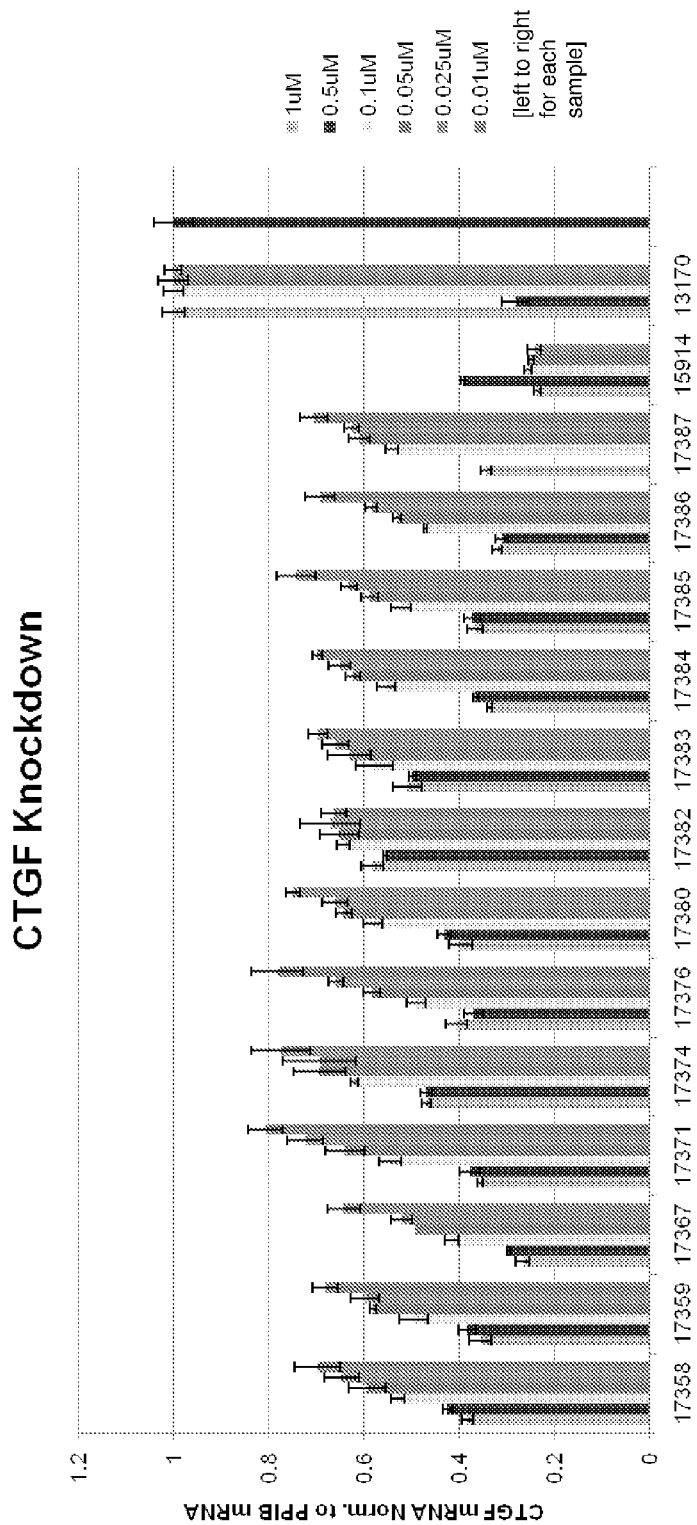
FIG. 12 demonstrates a dose response for sd-rxRNA molecules targeting CTGF.

In yet another embodiment of the present invention, the alteration of the composition of the fat emulsion is used as a way to alter tissue distribution of hydrophobicly modified polynucleotides. This methodology provides for the specific delivery of the polynucleotides to particular tissues (FIG. 12).

In another embodiment the fat emulsions of the cargo molecule contain more then 70% of Linoleic acid ($C_{18}H_{32}O_2$) and/or cardiolipin are used for specifically delivering RNAi to heart muscle.

Fat emulsions, like intralipid have been used before as a delivery formulation for some non-water soluble drugs (such as Propofol, re-formulated as Diprivan). Unique features of the present invention include (a) the concept of combining modified polynucleotides with the hydrophobic compound(s), so it can be incorporated in the fat micelles and (b) mixing it with the fat emulsions to provide a reversible carrier. After injection into a blood stream, micelles usually bind to serum proteins, including albumin, HDL, LDL and other. This binding is reversible and eventually the fat is absorbed by cells. The polynucleotide, incorporated as a part of the micelle will then be delivered closely to the surface of the cells. After that cellular uptake might be happening though variable mechanisms, including but not limited to sterol type delivery.

Complexing Agents

Complexing agents bind to the oligonucleotides of the invention by a strong but non-covalent attraction (e.g., an electrostatic, van der Waals, pi-stacking, etc. interaction). In one embodiment, oligonucleotides of the invention can be complexed with a complexing agent to increase cellular uptake of oligonucleotides. An example of a complexing agent includes cationic lipids. Cationic lipids can be used to deliver oligonucleotides to cells. However, as discussed above, formulations free in cationic lipids are preferred in some embodiments.

The term "cationic lipid" includes lipids and synthetic lipids having both polar and non-polar domains and which are capable of being positively charged at or around physiological pH and which bind to polyanions, such as nucleic acids, and facilitate the delivery of nucleic acids into cells. In general cationic lipids include saturated and unsaturated alkyl and alicyclic ethers and esters of amines, amides, or derivatives thereof. Straight-chain and branched alkyl and alkenyl groups of cationic lipids can contain, e.g., from 1 to about 25 carbon atoms. Preferred straight chain or branched alkyl or alkene groups have six or more carbon atoms. Alicyclic groups include cholesterol and other steroid groups. Cationic lipids can be prepared with a variety of counterions (anions) including, e.g., $Cl^-$, $Br^-$, $I^-$, $F^-$, acetate, trifluoroacetate, sulfate, nitrite, and nitrate.

Examples of cationic lipids include polyethylenimine, polyamidoamine (PAMAM) starburst dendrimers, Lipofectin (a combination of DOTMA and DOPE), Lipofectase, LIPOFECTAMINE™ (e.g., LIPOFECTAMINE™ 2000), DOPE, Cytofectin (Gilead Sciences, Foster City, Calif.), and Eufectins (JBL, San Luis Obispo, Calif.). Exemplary cationic liposomes can be made from N-[1-(2,3-dioleoloxy)-propyl]-N,N,N-trimethylammonium chloride (DOTMA), N-[1-(2,3-dioleoloxy)-propyl]-N,N,N-trimethylammonium methylsulfate (DOTAP), 3β-[N—(N',N'-dimethylaminoethane)carbamoyl]cholesterol (DC-Chol), 2,3,-dioleyloxy-N-[2 (sperminecarboxamido)ethyl]-N,N-dimethyl-1-propanaminium trifluoroacetate (DOSPA), 1,2-dimyristyloxypropyl-3-dimethyl-hydroxyethyl ammonium bromide; and dimethyldioctadecylammonium bromide (DDAB). The cationic lipid N-(1-(2,3-dioleyloxy)propyl)-N,N,N-trimethylammonium chloride (DOTMA), for example, was found to increase 1000-fold the antisense effect of a phosphorothioate oligonucleotide. (Vlassov et al., 1994, Biochimica et Biophysica Acta 1197:95-108). Oligonucleotides can also be complexed with, e.g., poly (L-lysine) or avidin and lipids may, or may not, be included in this mixture, e.g., steryl-poly (L-lysine).

Cationic lipids have been used in the art to deliver oligonucleotides to cells (see, e.g., U.S. Pat. Nos. 5,855,910; 5,851, 548; 5,830,430; 5,780,053; 5,767,099; Lewis et al. 1996. *Proc. Natl. Acad. Sci. USA* 93:3176; Hope et al. 1998. *Molecular Membrane Biology* 15:1). Other lipid compositions which can be used to facilitate uptake of the instant oligonucleotides can be used in connection with the claimed methods. In addition to those listed supra, other lipid compositions are also known in the art and include, e.g., those taught in U.S. Pat. Nos. 4,235,871; 4,501,728; 4,837,028; 4,737,323.

In one embodiment lipid compositions can further comprise agents, e.g., viral proteins to enhance lipid-mediated transfections of oligonucleotides (Kamata, et al., 1994. *Nucl. Acids. Res.* 22:536). In another embodiment, oligonucleotides are contacted with cells as part of a composition comprising an oligonucleotide, a peptide, and a lipid as taught, e.g., in U.S. Pat. No. 5,736,392. Improved lipids have also been described which are serum resistant (Lewis, et al., 1996. *Proc. Natl. Acad. Sci.* 93:3176). Cationic lipids and other complexing agents act to increase the number of oligonucleotides carried into the cell through endocytosis.

In another embodiment N-substituted glycine oligonucleotides (peptoids) can be used to optimize uptake of oligonucleotides. Peptoids have been used to create cationic lipid-like compounds for transfection (Murphy, et al., 1998. *Proc. Natl. Acad. Sci.* 95:1517). Peptoids can be synthesized using standard methods (e.g., Zuckermann, R. N., et al. 1992. *J. Am. Chem. Soc.* 114:10646; Zuckermann, R. N., et al. 1992. *Int. J. Peptide Protein Res.* 40:497). Combinations of cationic lipids and peptoids, liptoids, can also be used to optimize uptake of the subject oligonucleotides (Hunag, et al., 1998. *Chemistry and Biology.* 5:345). Liptoids can be synthesized by elaborating peptoid oligonucleotides and coupling the amino terminal submonomer to a lipid via its amino group (Hunag, et al., 1998. *Chemistry and Biology.* 5:345).

It is known in the art that positively charged amino acids can be used for creating highly active cationic lipids (Lewis et al. 1996. *Proc. Natl. Acad. Sci. U.S.A.* 93:3176). In one embodiment, a composition for delivering oligonucleotides of the invention comprises a number of arginine, lysine, histidine or ornithine residues linked to a lipophilic moiety (see e.g., U.S. Pat. No. 5,777,153).

In another embodiment, a composition for delivering oligonucleotides of the invention comprises a peptide having from between about one to about four basic residues. These basic residues can be located, e.g., on the amino terminal, C-terminal, or internal region of the peptide. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine (can also be considered non-polar), asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Apart from the basic amino acids, a majority or all of the other residues of the peptide can be selected from the non-basic amino acids, e.g., amino acids other than lysine, arginine, or histidine. Preferably a preponderance of neutral amino acids with long neutral side chains are used.

In one embodiment, a composition for delivering oligonucleotides of the invention comprises a natural or synthetic polypeptide having one or more gamma carboxyglutamic acid residues, or γ-Gla residues. These gamma carboxyglutamic acid residues may enable the polypeptide to bind to each other and to membrane surfaces. In other words, a polypeptide having a series of γ-Gla may be used as a general delivery modality that helps an RNAi construct to stick to whatever membrane to which it comes in contact. This may at least slow RNAi constructs from being cleared from the blood stream and enhance their chance of homing to the target.

The gamma carboxyglutamic acid residues may exist in natural proteins (for example, prothrombin has 10 γ-Gla residues). Alternatively, they can be introduced into the purified, recombinantly produced, or chemically synthesized polypeptides by carboxylation using, for example, a vitamin K-dependent carboxylase. The gamma carboxyglutamic acid residues may be consecutive or non-consecutive, and the total number and location of such gamma carboxyglutamic acid residues in the polypeptide can be regulated/fine tuned to achieve different levels of "stickiness" of the polypeptide.

In one embodiment, the cells to be contacted with an oligonucleotide composition of the invention are contacted with a mixture comprising the oligonucleotide and a mixture comprising a lipid, e.g., one of the lipids or lipid compositions described supra for between about 12 hours to about 24 hours. In another embodiment, the cells to be contacted with an oligonucleotide composition are contacted with a mixture comprising the oligonucleotide and a mixture comprising a lipid, e.g., one of the lipids or lipid compositions described supra for between about 1 and about five days. In one embodiment, the cells are contacted with a mixture comprising a lipid and the oligonucleotide for between about three days to as long as about 30 days. In another embodiment, a mixture comprising a lipid is left in contact with the cells for at least about five to about 20 days. In another embodiment, a mixture comprising a lipid is left in contact with the cells for at least about seven to about 15 days.

For example, in one embodiment, an oligonucleotide composition can be contacted with cells in the presence of a lipid such as cytofectin CS or GSV (available from Glen Research; Sterling, Va.), GS3815, GS2888 for prolonged incubation periods as described herein.

In one embodiment, the incubation of the cells with the mixture comprising a lipid and an oligonucleotide composition does not reduce the viability of the cells. Preferably, after the transfection period the cells are substantially viable. In one embodiment, after transfection, the cells are between at least about 70% and at least about 100% viable. In another embodiment, the cells are between at least about 80% and at least about 95% viable. In yet another embodiment, the cells are between at least about 85% and at least about 90% viable.

In one embodiment, oligonucleotides are modified by attaching a peptide sequence that transports the oligonucleotide into a cell, referred to herein as a "transporting peptide." In one embodiment, the composition includes an oligonucleotide which is complementary to a target nucleic acid molecule encoding the protein, and a covalently attached transporting peptide.

The language "transporting peptide" includes an amino acid sequence that facilitates the transport of an oligonucleotide into a cell. Exemplary peptides which facilitate the transport of the moieties to which they are linked into cells are known in the art, and include, e.g., HIV TAT transcription factor, lactoferrin, Herpes VP22 protein, and fibroblast growth factor 2 (Pooga et al. 1998. *Nature Biotechnology.* 16:857; and Derossi et al. 1998. *Trends in Cell Biology.* 8:84; Elliott and O'Hare. 1997. Cell 88:223).

Oligonucleotides can be attached to the transporting peptide using known techniques, e.g., (Prochiantz, A. 1996. *Curr. Opin. Neurobiol.* 6:629; Derossi et al. 1998. *Trends Cell Biol.* 8:84; Troy et al. 1996. *J. Neurosci.* 16:253), Vives et al. 1997. *J. Biol. Chem.* 272:16010). For example, in one embodiment, oligonucleotides bearing an activated thiol group are linked via that thiol group to a cysteine present in a transport peptide (e.g., to the cysteine present in the β turn between the second and the third helix of the antennapedia homeodomain as taught, e.g., in Derossi et al. 1998. *Trends Cell Biol.* 8:84; Prochiantz. 1996. *Current Opinion in Neurobiol.* 6:629; Allinquant et al. 1995. J Cell Biol. 128:919). In another embodiment, a Boc-Cys-(Npys)OH group can be coupled to the transport peptide as the last (N-terminal) amino acid and an oligonucleotide bearing an SH group can be coupled to the peptide (Troy et al. 1996. *J. Neurosci.* 16:253).

In one embodiment, a linking group can be attached to a nucleomonomer and the transporting peptide can be covalently attached to the linker. In one embodiment, a linker can function as both an attachment site for a transporting peptide and can provide stability against nucleases. Examples of suitable linkers include substituted or unsubstituted $C_1$-$C_{20}$ alkyl chains, $C_2$-$C_{20}$ alkenyl chains, $C_2$-$C_{20}$ alkynyl chains, peptides, and heteroatoms (e.g., S, O, NH, etc.). Other exemplary linkers include bifunctional crosslinking agents such as sulfosuccinimidyl-4-(maleimidophenyl)-butyrate (SMPB) (see, e.g., Smith et al. Biochem J 1991.276: 417-2).

In one embodiment, oligonucleotides of the invention are synthesized as molecular conjugates which utilize receptor-mediated endocytotic mechanisms for delivering genes into cells (see, e.g., Bunnell et al. 1992. *Somatic Cell and Molecular Genetics.* 18:559, and the references cited therein).

Targeting Agents

The delivery of oligonucleotides can also be improved by targeting the oligonucleotides to a cellular receptor. The targeting moieties can be conjugated to the oligonucleotides or attached to a carrier group (i.e., poly(L-lysine) or liposomes) linked to the oligonucleotides. This method is well suited to cells that display specific receptor-mediated endocytosis.

For instance, oligonucleotide conjugates to 6-phosphomannosylated proteins are internalized 20-fold more efficiently by cells expressing mannose 6-phosphate specific receptors than free oligonucleotides. The oligonucleotides may also be coupled to a ligand for a cellular receptor using a biodegradable linker. In another example, the delivery construct is mannosylated streptavidin which forms a tight complex with biotinylated oligonucleotides. Mannosylated streptavidin was found to increase 20-fold the internalization of biotinylated oligonucleotides. (Vlassov et al. 1994. *Biochimica et Biophysica Acta* 1197:95-108).

In addition specific ligands can be conjugated to the polylysine component of polylysine-based delivery systems. For example, transferrin-polylysine, adenovirus-polylysine, and influenza virus hemagglutinin HA-2 N-terminal fusogenic peptides-polylysine conjugates greatly enhance receptor-mediated DNA delivery in eucaryotic cells. Mannosylated glycoprotein conjugated to poly(L-lysine) in aveolar macrophages has been employed to enhance the cellular uptake of oligonucleotides. Liang et al. 1999. *Pharmazie* 54:559-566.

Because malignant cells have an increased need for essential nutrients such as folic acid and transferrin, these nutrients can be used to target oligonucleotides to cancerous cells. For example, when folic acid is linked to poly(L-lysine) enhanced oligonucleotide uptake is seen in promyelocytic leukaemia (HL-60) cells and human melanoma (M-14) cells. Ginobbi et al. 1997. *Anticancer Res.* 17:29. In another example, liposomes coated with maleylated bovine serum albumin, folic acid, or ferric protoporphyrin IX, show enhanced cellular uptake of oligonucleotides in murine macrophages, KB cells, and 2.2.15 human hepatoma cells. Liang et al. 1999. *Pharmazie* 54:559-566.

Liposomes naturally accumulate in the liver, spleen, and reticuloendothelial system (so-called, passive targeting). By coupling liposomes to various ligands such as antibodies are protein A, they can be actively targeted to specific cell populations. For example, protein A-bearing liposomes may be pretreated with H-2K specific antibodies which are targeted to the mouse major histocompatibility complex-encoded H-2K protein expressed on L cells. (Vlassov et al. 1994. *Biochimica et Biophysica Acta* 1197:95-108).

Other in vitro and/or in vivo delivery of RNAi reagents are known in the art, and can be used to deliver the subject RNAi constructs. See, for example, U.S. patent application publications 20080152661, 20080112916, 20080107694, 20080038296, 20070231392, 20060240093, 20060178327, 20060008910, 20050265957, 20050064595, 20050042227, 20050037496, 20050026286, 20040162235, 20040072785, 20040063654, 20030157030, WO 2008/036825, WO04/065601, and AU2004206255B2, just to name a few (all incorporated by reference).

Administration

The optimal course of administration or delivery of the oligonucleotides may vary depending upon the desired result and/or on the subject to be treated. As used herein "administration" refers to contacting cells with oligonucleotides and can be performed in vitro or in vivo. The dosage of oligonucleotides may be adjusted to optimally reduce expression of a protein translated from a target nucleic acid molecule, e.g., as measured by a readout of RNA stability or by a therapeutic response, without undue experimentation.

For example, expression of the protein encoded by the nucleic acid target can be measured to determine whether or not the dosage regimen needs to be adjusted accordingly. In addition, an increase or decrease in RNA or protein levels in a cell or produced by a cell can be measured using any art recognized technique. By determining whether transcription has been decreased, the effectiveness of the oligonucleotide in inducing the cleavage of a target RNA can be determined.

Any of the above-described oligonucleotide compositions can be used alone or in conjunction with a pharmaceutically acceptable carrier. As used herein, "pharmaceutically acceptable carrier" includes appropriate solvents, dispersion media, coatings, antibacterial and antifungal agents, isotonic and absorption delaying agents, and the like. The use of such media and agents for pharmaceutical active substances is well known in the art. Except insofar as any conventional media or agent is incompatible with the active ingredient, it can be used in the therapeutic compositions. Supplementary active ingredients can also be incorporated into the compositions.

Oligonucleotides may be incorporated into liposomes or liposomes modified with polyethylene glycol or admixed with cationic lipids for parenteral administration. Incorporation of additional substances into the liposome, for example, antibodies reactive against membrane proteins found on specific target cells, can help target the oligonucleotides to specific cell types.

With respect to in vivo applications, the formulations of the present invention can be administered to a patient in a variety of forms adapted to the chosen route of administration, e.g., parenterally, orally, or intraperitoneally. Parenteral administration, which is preferred, includes administration by the following routes: intravenous; intramuscular; interstitially; intraarterially; subcutaneous; intra ocular; intrasynovial; trans epithelial, including transdermal; pulmonary via inhalation; ophthalmic; sublingual and buccal; topically, including ophthalmic; dermal; ocular; rectal; and nasal inhalation via insufflation. In preferred embodiments, the sd-rxRNA molecules are administered by intradermal injection or subcutaneously.

Pharmaceutical preparations for parenteral administration include aqueous solutions of the active compounds in water-soluble or water-dispersible form. In addition, suspensions of the active compounds as appropriate oily injection suspensions may be administered. Suitable lipophilic solvents or vehicles include fatty oils, for example, sesame oil, or synthetic fatty acid esters, for example, ethyl oleate or triglycerides. Aqueous injection suspensions may contain substances which increase the viscosity of the suspension include, for example, sodium carboxymethyl cellulose, sorbitol, or dextran, optionally, the suspension may also contain stabilizers. The oligonucleotides of the invention can be formulated in liquid solutions, preferably in physiologically compatible buffers such as Hank's solution or Ringer's solution. In addition, the oligonucleotides may be formulated in solid form and redissolved or suspended immediately prior to use. Lyophilized forms are also included in the invention.

Pharmaceutical preparations for topical administration include transdermal patches, ointments, lotions, creams, gels, drops, sprays, suppositories, liquids and powders. In addition, conventional pharmaceutical carriers, aqueous, powder or oily bases, or thickeners may be used in pharmaceutical preparations for topical administration.

Pharmaceutical preparations for oral administration include powders or granules, suspensions or solutions in water or non-aqueous media, capsules, sachets or tablets. In addition, thickeners, flavoring agents, diluents, emulsifiers, dispersing aids, or binders may be used in pharmaceutical preparations for oral administration.

For transmucosal or transdermal administration, penetrants appropriate to the barrier to be permeated are used in the formulation. Such penetrants are known in the art, and include, for example, for transmucosal administration bile salts and fusidic acid derivatives, and detergents. Transmucosal administration may be through nasal sprays or using suppositories. For oral administration, the oligonucleotides are formulated into conventional oral administration forms such as capsules, tablets, and tonics. For topical administration, the oligonucleotides of the invention are formulated into ointments, salves, gels, or creams as known in the art.

Drug delivery vehicles can be chosen e.g., for in vitro, for systemic, or for topical administration. These vehicles can be designed to serve as a slow release reservoir or to deliver their contents directly to the target cell. An advantage of using some direct delivery drug vehicles is that multiple molecules are delivered per uptake. Such vehicles have been shown to increase the circulation half-life of drugs that would otherwise be rapidly cleared from the blood stream. Some examples of such specialized drug delivery vehicles which fall into this category are liposomes, hydrogels, cyclodextrins, biodegradable nanocapsules, and bioadhesive microspheres.

The described oligonucleotides may be administered systemically to a subject. Systemic absorption refers to the entry of drugs into the blood stream followed by distribution throughout the entire body. Administration routes which lead to systemic absorption include: intravenous, subcutaneous, intraperitoneal, and intranasal. Each of these administration routes delivers the oligonucleotide to accessible diseased cells. Following subcutaneous administration, the therapeutic agent drains into local lymph nodes and proceeds through the lymphatic network into the circulation. The rate of entry into the circulation has been shown to be a function of molecular weight or size. The use of a liposome or other drug carrier localizes the oligonucleotide at the lymph node. The oligonucleotide can be modified to diffuse into the cell, or the liposome can directly participate in the delivery of either the unmodified or modified oligonucleotide into the cell.

The chosen method of delivery will result in entry into cells. In some embodiments, preferred delivery methods include liposomes (10-400 nm), hydrogels, controlled-release polymers, and other pharmaceutically applicable vehicles, and microinjection or electroporation (for ex vivo treatments).

The pharmaceutical preparations of the present invention may be prepared and formulated as emulsions. Emulsions are usually heterogeneous systems of one liquid dispersed in another in the form of droplets usually exceeding 0.1 μm in diameter. The emulsions of the present invention may contain excipients such as emulsifiers, stabilizers, dyes, fats, oils, waxes, fatty acids, fatty alcohols, fatty esters, humectants, hydrophilic colloids, preservatives, and anti-oxidants may also be present in emulsions as needed. These excipients may be present as a solution in either the aqueous phase, oily phase or itself as a separate phase.

Examples of naturally occurring emulsifiers that may be used in emulsion formulations of the present invention include lanolin, beeswax, phosphatides, lecithin and acacia. Finely divided solids have also been used as good emulsifiers especially in combination with surfactants and in viscous preparations. Examples of finely divided solids that may be used as emulsifiers include polar inorganic solids, such as heavy metal hydroxides, nonswelling clays such as bentonite, attapulgite, hectorite, kaolin, montrnorillonite, colloidal aluminum silicate and colloidal magnesium aluminum silicate, pigments and nonpolar solids such as carbon or glyceryl tristearate.

Examples of preservatives that may be included in the emulsion formulations include methyl paraben, propyl paraben, quaternary ammonium salts, benzalkonium chloride, esters of p-hydroxybenzoic acid, and boric acid. Examples of antioxidants that may be included in the emulsion formulations include free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

In one embodiment, the compositions of oligonucleotides are formulated as microemulsions. A microemulsion is a system of water, oil and amphiphile which is a single optically isotropic and thermodynamically stable liquid solution. Typically microemulsions are prepared by first dispersing an oil in an aqueous surfactant solution and then adding a sufficient amount of a 4th component, generally an intermediate chain-length alcohol to form a transparent system.

Surfactants that may be used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (S0750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules.

Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain ($C_8$-$C_{12}$) mono, di, and tri-glycerides, polyoxyethylated glyceryl fatty acid esters, fatty alcohols, polyglycolized glycerides, saturated polyglycolized $C_8$-$C_{10}$ glycerides, vegetable oils and silicone oil.

Microemulsions are particularly of interest from the standpoint of drug solubilization and the enhanced absorption of drugs. Lipid based microemulsions (both oil/water and water/oil) have been proposed to enhance the oral bioavailability of drugs.

Microemulsions offer improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11:1385; Ho et al., J. Pharm. Sci., 1996, 85:138-143). Microemulsions have also been effective in the transdermal delivery of active components in both cosmetic and pharmaceutical applications. It is expected that the microemulsion compositions and formulations of the present invention will facilitate the increased systemic absorption of oligonucleotides from the gastrointestinal tract, as well as improve the local cellular uptake of oligonucleotides within the gastrointestinal tract, vagina, buccal cavity and other areas of administration.

In an embodiment, the present invention employs various penetration enhancers to affect the efficient delivery of nucleic acids, particularly oligonucleotides, to the skin of animals. Even non-lipophilic drugs may cross cell membranes if the membrane to be crossed is treated with a penetration enhancer. In addition to increasing the diffusion of non-lipophilic drugs across cell membranes, penetration enhancers also act to enhance the permeability of lipophilic drugs.

Five categories of penetration enhancers that may be used in the present invention include: surfactants, fatty acids, bile salts, chelating agents, and non-chelating non-surfactants. Other agents may be utilized to enhance the penetration of the administered oligonucleotides include: glycols such as ethylene glycol and propylene glycol, pyrrols such as 2-15 pyrrol, azones, and terpenes such as limonene, and menthone.

The oligonucleotides, especially in lipid formulations, can also be administered by coating a medical device, for example, a catheter, such as an angioplasty balloon catheter, with a cationic lipid formulation. Coating may be achieved, for example, by dipping the medical device into a lipid formulation or a mixture of a lipid formulation and a suitable solvent, for example, an aqueous-based buffer, an aqueous solvent, ethanol, methylene chloride, chloroform and the like. An amount of the formulation will naturally adhere to the surface of the device which is subsequently administered to a patient, as appropriate. Alternatively, a lyophilized mixture of a lipid formulation may be specifically bound to the surface of the device. Such binding techniques are described, for example, in K. Ishihara et al., Journal of Biomedical Materials Research, Vol. 27, pp. 1309-1314 (1993), the disclosures of which are incorporated herein by reference in their entirety.

The useful dosage to be administered and the particular mode of administration will vary depending upon such factors as the cell type, or for in vivo use, the age, weight and the particular animal and region thereof to be treated, the particular oligonucleotide and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved. When lipids are used to deliver the oligonucleotides, the amount of lipid compound that is administered can vary and generally depends upon the amount of oligonucleotide agent being administered. For example, the weight ratio of lipid compound to oligonucleotide agent is preferably from about 1:1 to about 15:1, with a weight ratio of about 5:1 to about 10:1 being more preferred. Generally, the amount of cationic lipid compound which is administered will vary from between about 0.1 milligram (mg) to about 1 gram (g). By way of general guidance, typically between about 0.1 mg and about 10 mg of the particular oligonucleotide agent, and about 1 mg to about 100 mg of the lipid compositions, each per kilogram of patient body weight, is administered, although higher and lower amounts can be used.

The agents of the invention are administered to subjects or contacted with cells in a biologically compatible form suitable for pharmaceutical administration. By "biologically compatible form suitable for administration" is meant that the oligonucleotide is administered in a form in which any toxic effects are outweighed by the therapeutic effects of the oligonucleotide. In one embodiment, oligonucleotides can be administered to subjects. Examples of subjects include mammals, e.g., humans and other primates; cows, pigs, horses, and farming (agricultural) animals; dogs, cats, and other domesticated pets; mice, rats, and transgenic non-human animals.

Administration of an active amount of an oligonucleotide of the present invention is defined as an amount effective, at dosages and for periods of time necessary to achieve the desired result. For example, an active amount of an oligonucleotide may vary according to factors such as the type of cell, the oligonucleotide used, and for in vivo uses the disease state, age, sex, and weight of the individual, and the ability of the oligonucleotide to elicit a desired response in the individual. Establishment of therapeutic levels of oligonucleotides within the cell is dependent upon the rates of uptake and efflux or degradation. Decreasing the degree of degradation prolongs the intracellular half-life of the oligonucleotide. Thus, chemically-modified oligonucleotides, e.g., with modification of the phosphate backbone, may require different dosing.

The exact dosage of an oligonucleotide and number of doses administered will depend upon the data generated experimentally and in clinical trials. Several factors such as the desired effect, the delivery vehicle, disease indication, and the route of administration, will affect the dosage. Dosages can be readily determined by one of ordinary skill in the art and formulated into the subject pharmaceutical compositions. Preferably, the duration of treatment will extend at least through the course of the disease symptoms.

Dosage regimens may be adjusted to provide the optimum therapeutic response. For example, the oligonucleotide may be repeatedly administered, e.g., several doses may be administered daily or the dose may be proportionally reduced as indicated by the exigencies of the therapeutic situation. One of ordinary skill in the art will readily be able to determine appropriate doses and schedules of administration of the subject oligonucleotides, whether the oligonucleotides are to be administered to cells or to subjects.

Administration of sd-rxRNAs, such as through intradermal injection or subcutaneous delivery, can be optimized through testing of dosing regimens. In some embodiments, a single administration is sufficient. To further prolong the effect of the administered sd-rxRNA, the sd-rxRNA can be administered in a slow-release formulation or device, as would be familiar to one of ordinary skill in the art. The hydrophobic nature of sd-rxRNA compounds can enable use of a wide variety of polymers, some of which are not compatible with conventional oligonucleotide delivery.

In other embodiments, the sd-rxRNA is administered multiple times. In some instances it is administered daily, bi-weekly, weekly, every two weeks, every three weeks, monthly, every two months, every three months, every four months, every five months, every six months or less frequently than every six months. In some instances, it is administered multiple times per day, week, month and/or year. For example, it can be administered approximately every hour, 2 hours, 3 hours, 4 hours, 5 hours, 6 hours, 7 hours, 8 hours, 9 hours 10 hours, 12 hours or more than twelve hours. It can be administered 1, 2, 3, 4, 5, 6, 7, 8, 9, 10 or more than 10 times per day.

Aspects of the invention relate to administering sd-rxRNA molecules to a subject. In some instances the subject is a patient and administering the sd-rxRNA molecule involves administering the sd-rxRNA molecule in a doctor's office.

In some embodiments, more than one sd-rxRNA molecule is administered simultaneously. For example a composition may be administered that contains 1, 2, 3, 4, 5, 6, 7, 8, 9, 10 or more than 10 different sd-rxRNA molecules. In certain embodiments, a composition comprises 2 or 3 different sd-rxRNA molecules. When a composition comprises more than one sd-rxRNA, the sd-rxRNA molecules within the composition can be directed to the same gene or to different genes.

Figure 7:
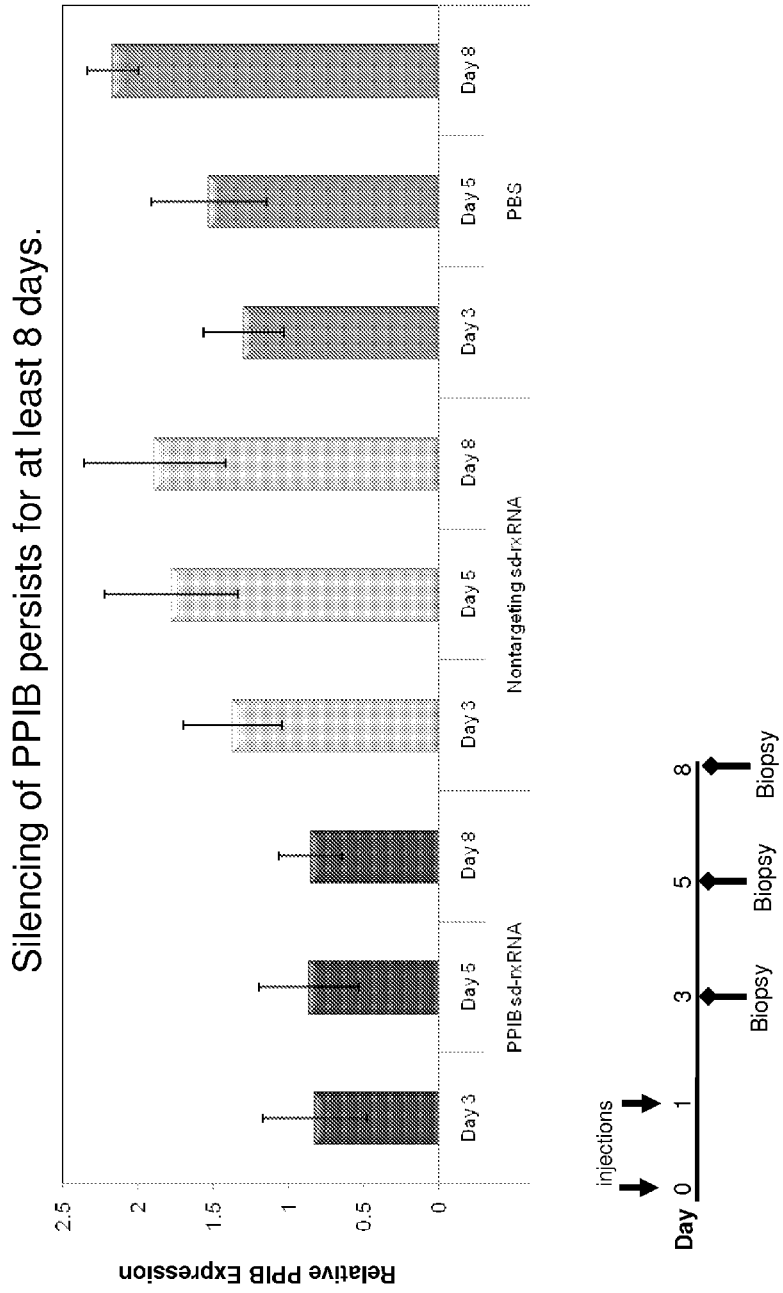
FIG. 7 demonstrates the duration of PPIB silencing following intradermal injection of sd-rxRNA targeting PPIB.
Figure 8:
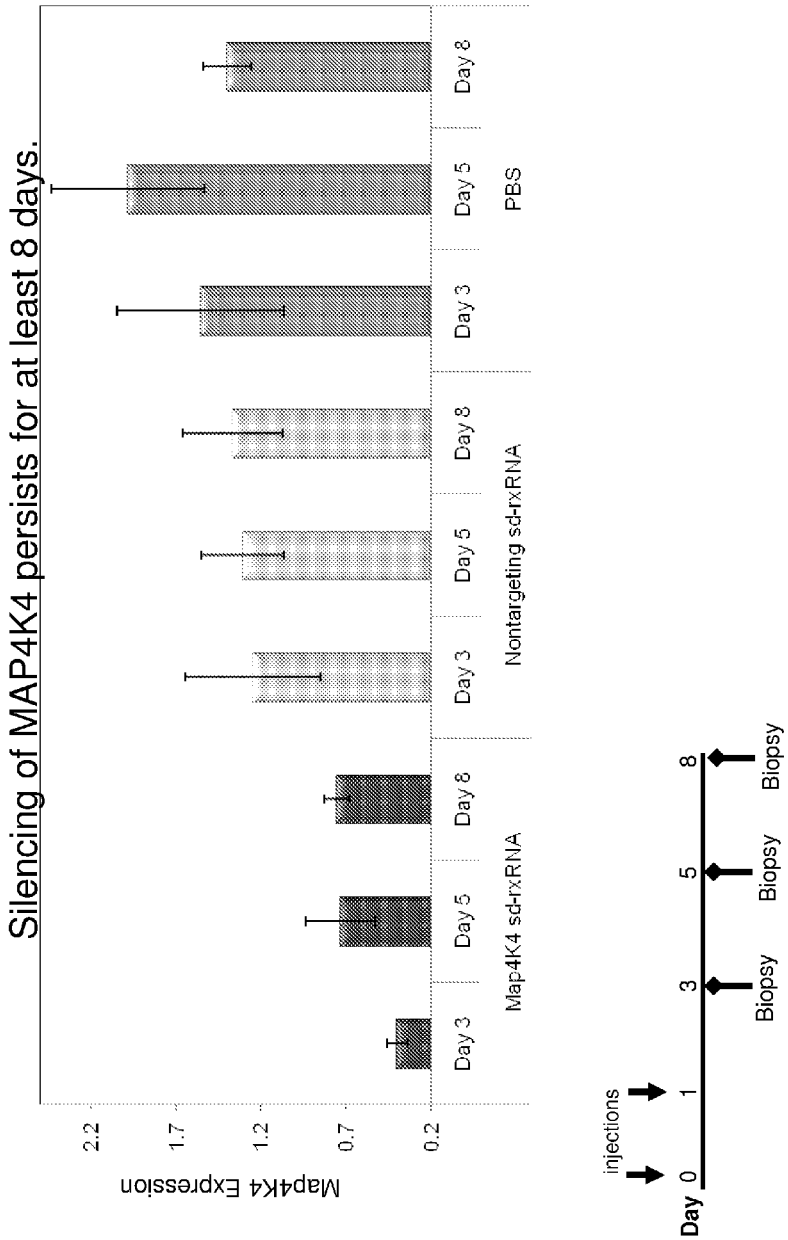
FIG. 8 demonstrates the duration of MAP4K4 silencing following intradermal injection of sd-rxRNA targeting MAP4K4.
Figure 9:
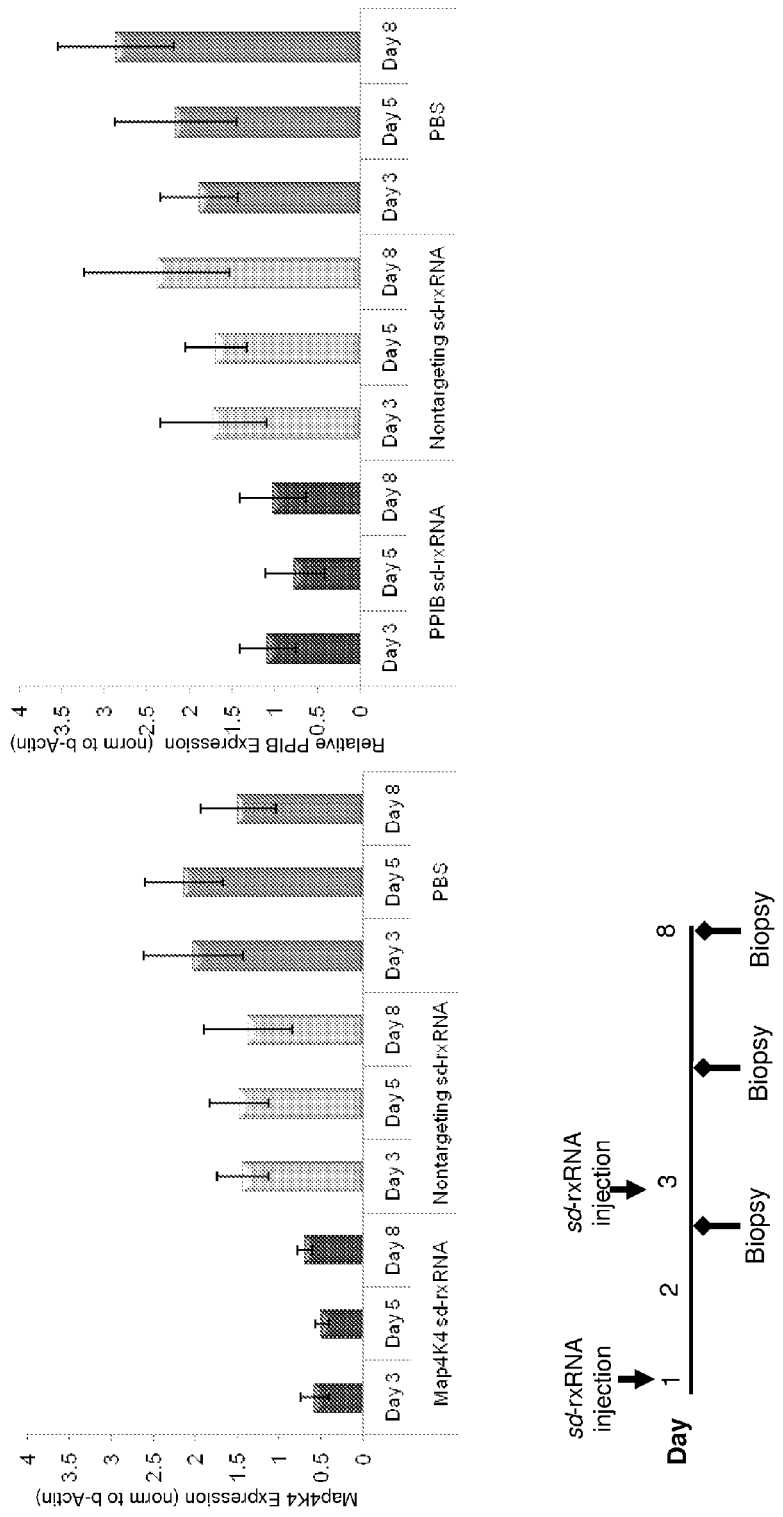
FIG. 9 demonstrates equivalent silencing achieved using two different dosing regimens.

FIG. 1 reveals the expression profile for several genes associated with the invention. As expected, target gene expression is elevated early and returns to normal by day 10. FIG. 2 provides a summary of experimental design. FIGS. 3-6 show in vivo silencing of MAP4K4 and PPIB expression following intradermal injection of sd-rxRNA molecules targeting these genes. FIGS. 7-8 show that the silencing effect of sd-rxRNAs can persist for at least 8 days. Thus, in some embodiments, sd-rxRNA is administered within 8 days prior to an event that compromises or damages the skin such as a surgery. For examples, an sd-rxRNA could be administered 1, 2, 3, 4, 5, 6, 7, 8, 9, 10 or more than 10 days prior to an event that compromises or damages the skin. FIG. 9 demonstrates examples of dosing regimens.

In some instances, the effective amount of sd-rxRNA that is delivered by subcutaneous administration is at least approximately 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more than 100 mg/kg including any intermediate values.

In some instances, the effective amount of sd-rxRNA that is delivered through intradermal injection is at least approximately 1, 5, 10, 15, 20, 25, 30, 35, 40, 45, 50, 55, 60, 65, 70, 75, 80, 85, 90, 95, 100, 125, 150, 200, 250, 300, 350, 400, 450, 500, 550, 600, 650, 700, 750, 800, 850, 900, 950 or more than 950 µg including any intermediate values.

sd-rxRNA molecules administered through methods described herein are effectively targeted to all the cell types in the skin.

Physical methods of introducing nucleic acids include injection of a solution containing the nucleic acid, bombardment by particles covered by the nucleic acid, soaking the cell or organism in a solution of the nucleic acid, or electroporation of cell membranes in the presence of the nucleic acid. A viral construct packaged into a viral particle would accomplish both efficient introduction of an expression construct into the cell and transcription of nucleic acid encoded by the expression construct. Other methods known in the art for introducing nucleic acids to cells may be used, such as lipid-mediated carrier transport, chemical-mediated transport, such as calcium phosphate, and the like. Thus the nucleic acid may be introduced along with components that perform one or more of the following activities: enhance nucleic acid uptake by the cell, inhibit annealing of single strands, stabilize the single strands, or other-wise increase inhibition of the target gene.

Nucleic acid may be directly introduced into the cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The cell with the target gene may be derived from or contained in any organism. The organism may a plant, animal, protozoan, bacterium, virus, or fungus. The plant may be a monocot, dicot or gymnosperm; the animal may be a vertebrate or invertebrate. Preferred microbes are those used in agriculture or by industry, and those that are pathogenic for plants or animals.

Alternatively, vectors, e.g., transgenes encoding a siRNA of the invention can be engineered into a host cell or transgenic animal using art recognized techniques.

A further preferred use for the agents of the present invention (or vectors or transgenes encoding same) is a functional analysis to be carried out in eukaryotic cells, or eukaryotic non-human organisms, preferably mammalian cells or organisms and most preferably human cells, e.g. cell lines such as HeLa or 293 or rodents, e.g. rats and mice. By administering a suitable priming agent/RNAi agent which is sufficiently complementary to a target mRNA sequence to direct target-specific RNA interference, a specific knockout or knockdown phenotype can be obtained in a target cell, e.g. in cell culture or in a target organism.

Thus, a further subject matter of the invention is a eukaryotic cell or a eukaryotic non-human organism exhibiting a target gene-specific knockout or knockdown phenotype comprising a fully or at least partially deficient expression of at least one endogenous target gene wherein said cell or organism is transfected with at least one vector comprising DNA encoding an RNAi agent capable of inhibiting the expression of the target gene. It should be noted that the present invention allows a target-specific knockout or knockdown of several different endogenous genes due to the specificity of the RNAi agent.

Gene-specific knockout or knockdown phenotypes of cells or non-human organisms, particularly of human cells or non-human mammals may be used in analytic to procedures, e.g. in the functional and/or phenotypical analysis of complex physiological processes such as analysis of gene expression profiles and/or proteomes. Preferably the analysis is carried out by high throughput methods using oligonucleotide based chips.

Assays of Oligonucleotide Stability

In some embodiments, the oligonucleotides of the invention are stabilized, i.e., substantially resistant to endonuclease and exonuclease degradation. An oligonucleotide is defined as being substantially resistant to nucleases when it is at least about 3-fold more resistant to attack by an endogenous cellular nuclease, and is highly nuclease resistant when it is at least about 6-fold more resistant than a corresponding oligonucleotide. This can be demonstrated by showing that the oligonucleotides of the invention are substantially resistant to nucleases using techniques which are known in the art.

One way in which substantial stability can be demonstrated is by showing that the oligonucleotides of the invention function when delivered to a cell, e.g., that they reduce transcription or translation of target nucleic acid molecules, e.g., by measuring protein levels or by measuring cleavage of mRNA. Assays which measure the stability of target RNA can be performed at about 24 hours post-transfection (e.g., using Northern blot techniques, RNase Protection Assays, or QC-PCR assays as known in the art). Alternatively, levels of the target protein can be measured. Preferably, in addition to testing the RNA or protein levels of interest, the RNA or protein levels of a control, non-targeted gene will be measured (e.g., actin, or preferably a control with sequence similarity to the target) as a specificity control. RNA or protein measurements can be made using any art-recognized technique. Preferably, measurements will be made beginning at about 16-24 hours post transfection. (M. Y. Chiang, et al. 1991. J Biol Chem. 266:18162-71; T. Fisher, et al. 1993. Nucleic Acids Research. 21 3857).

The ability of an oligonucleotide composition of the invention to inhibit protein synthesis can be measured using techniques which are known in the art, for example, by detecting an inhibition in gene transcription or protein synthesis. For example, Nuclease S1 mapping can be performed. In another example, Northern blot analysis can be used to measure the presence of RNA encoding a particular protein. For example, total RNA can be prepared over a cesium chloride cushion (see, e.g., Ausebel et al., 1987. Current Protocols in Molecular Biology (Greene & Wiley, New York)). Northern blots can then be made using the RNA and probed (see, e.g., Id.). In another example, the level of the specific mRNA produced by the target protein can be measured, e.g., using PCR. In yet another example, Western blots can be used to measure the amount of target protein present. In still another embodiment, a phenotype influenced by the amount of the protein can be detected. Techniques for performing Western blots are well known in the art, see, e.g., Chen et al. J. Biol. Chem. 271: 28259.

In another example, the promoter sequence of a target gene can be linked to a reporter gene and reporter gene transcription (e.g., as described in more detail below) can be monitored. Alternatively, oligonucleotide compositions that do not target a promoter can be identified by fusing a portion of the target nucleic acid molecule with a reporter gene so that the reporter gene is transcribed. By monitoring a change in the expression of the reporter gene in the presence of the oligonucleotide composition, it is possible to determine the effectiveness of the oligonucleotide composition in inhibiting the expression of the reporter gene. For example, in one embodiment, an effective oligonucleotide composition will reduce the expression of the reporter gene.

A "reporter gene" is a nucleic acid that expresses a detectable gene product, which may be RNA or protein. Detection of mRNA expression may be accomplished by Northern blotting and detection of protein may be accomplished by staining with antibodies specific to the protein. Preferred reporter genes produce a readily detectable product. A reporter gene may be operably linked with a regulatory DNA sequence such that detection of the reporter gene product provides a measure of the transcriptional activity of the regulatory sequence. In preferred embodiments, the gene product of the reporter gene is detected by an intrinsic activity associated with that product. For instance, the reporter gene may encode a gene product that, by enzymatic activity, gives rise to a detectable signal based on color, fluorescence, or luminescence. Examples of reporter genes include, but are not limited to, those coding for chloramphenicol acetyl transferase (CAT), luciferase, beta-galactosidase, and alkaline phosphatase.

One skilled in the art would readily recognize numerous reporter genes suitable for use in the present invention. These include, but are not limited to, chloramphenicol acetyltransferase (CAT), luciferase, human growth hormone (hGH), and beta-galactosidase. Examples of such reporter genes can be found in F. A. Ausubel et al., Eds., Current Protocols in Molecular Biology, John Wiley & Sons, New York, (1989). Any gene that encodes a detectable product, e.g., any product having detectable enzymatic activity or against which a specific antibody can be raised, can be used as a reporter gene in the present methods.

One reporter gene system is the firefly luciferase reporter system. (Gould, S. J., and Subramani, S. 1988. Anal. Biochem., 7:404-408 incorporated herein by reference). The luciferase assay is fast and sensitive. In this assay, a lysate of the test cell is prepared and combined with ATP and the substrate luciferin. The encoded enzyme luciferase catalyzes a rapid, ATP dependent oxidation of the substrate to generate a light-emitting product. The total light output is measured and is proportional to the amount of luciferase present over a wide range of enzyme concentrations.

CAT is another frequently used reporter gene system; a major advantage of this system is that it has been an extensively validated and is widely accepted as a measure of promoter activity. (Gorman C. M., Moffat, L. F., and Howard, B. H. 1982. Mol. Cell. Biol., 2:1044-1051). In this system, test cells are transfected with CAT expression vectors and incubated with the candidate substance within 2-3 days of the initial transfection. Thereafter, cell extracts are prepared. The extracts are incubated with acetyl CoA and radioactive chloramphenicol. Following the incubation, acetylated chloramphenicol is separated from nonacetylated form by thin layer chromatography. In this assay, the degree of acetylation reflects the CAT gene activity with the particular promoter.

Another suitable reporter gene system is based on immunologic detection of hGH. This system is also quick and easy to use. (Selden, R., Burke-Howie, K. Rowe, M. E., Goodman, H. M., and Moore, D. D. (1986), Mol. Cell, Biol., 6:3173-3179 incorporated herein by reference). The hGH system is advantageous in that the expressed hGH polypeptide is assayed in the media, rather than in a cell extract. Thus, this system does not require the destruction of the test cells. It will be appreciated that the principle of this reporter gene system is not limited to hGH but rather adapted for use with any polypeptide for which an antibody of acceptable specificity is available or can be prepared.

In one embodiment, nuclease stability of a double-stranded oligonucleotide of the invention is measured and compared to a control, e.g., an RNAi molecule typically used in the art (e.g., a duplex oligonucleotide of less than 25 nucleotides in length and comprising 2 nucleotide base overhangs) or an unmodified RNA duplex with blunt ends.

The target RNA cleavage reaction achieved using the siRNAs of the invention is highly sequence specific. Sequence identity may determined by sequence comparison and alignment algorithms known in the art. To determine the percent identity of two nucleic acid sequences (or of two amino acid sequences), the sequences are aligned for optimal comparison purposes (e.g., gaps can be introduced in the first sequence or second sequence for optimal alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10. Greater than 90% sequence identity, e.g., 91%, 92%, 93%, 94%, 95%, 96%, 97%, 98%, 99% or even 100% sequence identity, between the siRNA and the portion of the target gene is preferred. Alternatively, the siRNA may be defined functionally as a nucleotide sequence (or oligonucleotide sequence) that is capable of hybridizing with a portion of the target gene transcript. Examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4, incorporated herein by reference.

Therapeutic Use

By inhibiting the expression of a gene, the oligonucleotide compositions of the present invention can be used to treat any disease involving the expression of a protein. Examples of diseases that can be treated by oligonucleotide compositions, just to illustrate, include: cancer, retinopathies, autoimmune diseases, inflammatory diseases (i.e., ICAM-1 related disorders, Psoriasis, Ulcerative Colitus, Crohn's disease), viral diseases (i.e., HIV, Hepatitis C), miRNA disorders, and cardiovascular diseases.

In one embodiment, in vitro treatment of cells with oligonucleotides can be used for ex vivo therapy of cells removed from a subject (e.g., for treatment of leukemia or viral infection) or for treatment of cells which did not originate in the subject, but are to be administered to the subject (e.g., to eliminate transplantation antigen expression on cells to be transplanted into a subject). In addition, in vitro treatment of cells can be used in non-therapeutic settings, e.g., to evaluate gene function, to study gene regulation and protein synthesis or to evaluate improvements made to oligonucleotides designed to modulate gene expression or protein synthesis. In vivo treatment of cells can be useful in certain clinical settings where it is desirable to inhibit the expression of a protein. There are numerous medical conditions for which antisense therapy is reported to be suitable (see, e.g., U.S. Pat. No. 5,830,653) as well as respiratory syncytial virus infection (WO 95/22,553) influenza virus (WO 94/23,028), and malignancies (WO 94/08,003). Other examples of clinical uses of antisense sequences are reviewed, e.g., in Glaser. 1996. *Genetic Engineering News* 16:1. Exemplary targets for cleavage by oligonucleotides include, e.g., protein kinase Ca, ICAM-1, c-raf kinase, p53, c-myb, and the bcr/abl fusion gene found in chronic myelogenous leukemia.

The subject nucleic acids can be used in RNAi-based therapy in any animal having RNAi pathway, such as human, non-human primate, non-human mammal, non-human vertebrates, rodents (mice, rats, hamsters, rabbits, etc.), domestic livestock animals, pets (cats, dogs, etc.), *Xenopus*, fish, insects (*Drosophila*, etc.), and worms (*C. elegans*), etc.

The invention provides methods for preventing in a subject, a disease or condition associated with an aberrant or unwanted target gene expression or activity, by administering to the subject a therapeutic agent (e.g., a RNAi agent or vector or transgene encoding same). If appropriate, subjects are first treated with a priming agent so as to be more responsive to the subsequent RNAi therapy. Subjects at risk for a disease which is caused or contributed to by aberrant or unwanted target gene expression or activity can be identified by, for example, any or a combination of diagnostic or prognostic assays as described herein. Administration of a prophylactic agent can occur prior to the manifestation of symptoms characteristic of the target gene aberrancy, such that a disease or disorder is prevented or, alternatively, delayed in its progression. Depending on the type of target gene aberrancy, for example, a target gene, target gene agonist or target gene antagonist agent can be used for treating the subject.

In another aspect, the invention pertains to methods of modulating target gene expression, protein expression or activity for therapeutic purposes. Accordingly, in an exemplary embodiment, the modulatory method of the invention involves contacting a cell capable of expressing target gene with a therapeutic agent of the invention that is specific for the target gene or protein (e.g., is specific for the mRNA encoded by said gene or specifying the amino acid sequence of said protein) such that expression or one or more of the activities of target protein is modulated. These modulatory methods can be performed in vitro (e.g., by culturing the cell with the agent), in vivo (e.g., by administering the agent to a subject), or ex vivo. Typically, subjects are first treated with a priming agent so as to be more responsive to the subsequent RNAi therapy. As such, the present invention provides methods of treating an individual afflicted with a disease or disorder characterized by aberrant or unwanted expression or activity of a target gene polypeptide or nucleic acid molecule. Inhibition of target gene activity is desirable in situations in which target gene is abnormally unregulated and/or in which decreased target gene activity is likely to have a beneficial effect.

The therapeutic agents of the invention can be administered to individuals to treat (prophylactically or therapeutically) disorders associated with aberrant or unwanted target gene activity. In conjunction with such treatment, pharmacogenomics (i.e., the study of the relationship between an individual's genotype and that individual's response to a foreign compound or drug) may be considered. Differences in metabolism of therapeutics can lead to severe toxicity or therapeutic failure by altering the relation between dose and blood concentration of the pharmacologically active drug. Thus, a physician or clinician may consider applying knowledge obtained in relevant pharmacogenomics studies in determining whether to administer a therapeutic agent as well as tailoring the dosage and/or therapeutic regimen of treatment with a therapeutic agent. Pharmacogenomics deals with clinically significant hereditary variations in the response to drugs due to altered drug disposition and abnormal action in affected persons. See, for example, Eichelbaum, M. et al. (1996) Clin. Exp. Pharmacol. Physiol. 23(10-11): 983-985 and Linder, M. W. et al. (1997) Clin. Chem. 43(2):254-266

RNAi in Skin Indications

Nucleic acid molecules, or compositions comprising nucleic acid molecules, described herein may in some embodiments be administered to pre-treat, treat or prevent compromised skin. As used herein "compromised skin"

refers to skin which exhibits characteristics distinct from normal skin. Compromised skin may occur in association with a dermatological condition. Several non-limiting examples of dermatological conditions include rosacea, common acne, seborrheic dermatitis, perioral dermatitis, acneform rashes, transient acantholytic dermatosis, and acne necrotica miliaris. In some instances, compromised skin may comprise a wound and/or scar tissue. In some instances, methods and compositions associated with the invention may be used to promote wound healing, prevention, reduction or inhibition of scarring, and/or promotion of re-epithelialisation of wounds.

A subject can be pre-treated or treated prophylactically with a molecule associated with the invention, prior to the skin of the subject becoming compromised. As used herein "pre-treatment" or "prophylactic treatment" refers to administering a nucleic acid to the skin prior to the skin becoming compromised. For example, a subject could be pre-treated 15 minutes, 30 minutes, 1 hour, 2 hours, 3 hours, 4 hours, 5 hours, 6 hours, 7 hours, 8 hours, 9 hours, 10 hours, 11 hours, 12 hours, 24 hours, 48 hours, 3 days, 4 days, 5 days, 6 days, 7 days, 8 days or more than 8 days prior to the skin becoming compromised. In other embodiments, a subject can be treated with a molecule associated with the invention immediately before the skin becomes compromised and/or simultaneous to the skin becoming compromised and/or after the skin has been compromised. In some embodiments, the skin is compromised through a medical procedure such as surgery, including elective surgery. In certain embodiments methods and compositions may be applied to areas of the skin that are believed to be at risk of becoming compromised. It should be appreciated that one of ordinary skill in the art would be able to optimize timing of administration using no more than routine experimentation.

In some aspects, methods associated with the invention can be applied to promote healing of compromised skin. Administration can occur at any time up until the compromised skin has healed, even if the compromised skin has already partially healed. The timing of administration can depend on several factors including the nature of the compromised skin, the degree of damage within the compromised skin, and the size of the compromised area. In some embodiments administration may occur immediately after the skin is compromised, or 30 minutes, 1 hour, 2 hours, 4 hours, 6 hours, 8 hours, 12 hours, 24 hours, 48 hours, or more than 48 hours after the skin has been compromised. Methods and compositions of the invention may be administered one or more times as necessary. For example, in some embodiments, compositions may be administered daily or twice daily. In some instances, compositions may be administered both before and after formation of compromised skin.

Compositions associated with the invention may be administered by any suitable route. In some embodiments, administration occurs locally at an area of compromised skin. For example, compositions may be administered by intradermal injection. Compositions for intradermal injection may include injectable solutions. Intradermal injection may in some embodiments occur around the are of compromised skin or at a site where the skin is likely to become compromised. In some embodiments, compositions may also be administered in a topical form, such as in a cream or ointment. In some embodiments, administration of compositions described herein comprises part of an initial treatment or pre-treatment of compromised skin, while in other embodiments, administration of such compositions comprises follow-up care for an area of compromised skin.

The appropriate amount of a composition or medicament to be applied can depend on many different factors and can be determined by one of ordinary skill in the art through routine experimentation. Several non-limiting factors that might be considered include biological activity and bioavailability of the agent, nature of the agent, mode of administration, half-life, and characteristics of the subject to be treated.

In some aspects, nucleic acid molecules associated with the invention may also be used in treatment and/or prevention of fibrotic disorders, including pulmonary fibrosis, liver cirrhosis, scleroderma and glomerulonephritis, lung fibrosis, liver fibrosis, skin fibrosis, muscle fibrosis, radiation fibrosis, kidney fibrosis, proliferative vitreoretinopathy, restenosis, and uterine fibrosis.

A therapeutically effective amount of a nucleic acid molecule described herein may in some embodiments be an amount sufficient to prevent the formation of compromised skin and/or improve the condition of compromised skin and/or to treat or prevent a fibrotic disorder. In some embodiments, improvement of the condition of compromised skin may correspond to promotion of wound healing and/or inhibition of scarring and/or promotion of epithelial regeneration. The extent of prevention of formation of compromised skin and/or improvement to the condition of compromised skin may in some instances be determined by, for example, a doctor or clinician.

The ability of nucleic acid molecules associated with the invention to prevent the formation of compromised skin and/or improve the condition of compromised skin may in some instances be measured with reference to properties exhibited by the skin. In some instances, these properties may include rate of epithelialisation and/or decreased size of an area of compromised skin compared to control skin at comparable time points.

As used herein, prevention of formation of compromised skin, for example prior to a surgical procedure, and/or improvement of the condition of compromised skin, for example after a surgical procedure, can encompass any increase in the rate of healing in the compromised skin as compared with the rate of healing occurring in a control sample. In some instances, the condition of compromised skin may be assessed with respect to either comparison of the rate of re-epithelialisation achieved in treated and control skin, or comparison of the relative areas of treated and control areas of compromised skin at comparable time points. In some aspects, a molecule that prevents formation of compromised skin or promotes healing of compromised skin may be a molecule that, upon administration, causes the area of compromised skin to exhibit an increased rate of re-epithelialisation and/or a reduction of the size of compromised skin compared to a control at comparable time points. In some embodiments, the healing of compromised skin may give rise to a rate of healing that is 5%, 10%, 20%, 30%, 40%, 50%, 60%, 70%, 80%, 90% or 100% greater than the rate occurring in controls.

In some aspects, subjects to be treated by methods and compositions associated with the invention may be subjects who will undergo, are undergoing or have undergone a medical procedure such as a surgery. In some embodiments, the subject may be prone to defective, delayed or otherwise impaired re-epithelialisation, such as dermal wounds in the aged. Other non-limiting examples of conditions or disorders in which wound healing is associated with delayed or otherwise impaired re-epithelialisation include patients suffering from diabetes, patients with polypharmacy, post-menopausal women, patients susceptible to pressure injuries, patients with venous disease, clinically obese patients, patients receiving chemotherapy, patients receiving radiotherapy, patients receiving steroid treatment, and immuno-compromised patients. In some instances, defective re-epithelialisation response can contributes to infections at the wound site, and to the formation of chronic wounds such as ulcers.

In some embodiments, methods associated with the invention may promote the re-epithelialisation of compromised skin in chronic wounds, such as ulcers, and may also inhibit scarring associated with wound healing. In other embodiments, methods associated with the invention are applied to prevention or treatment of compromised skin in acute wounds in patients predisposed to impaired wound healing developing into chronic wounds. In other aspects, methods associated with the invention are applied to promote accelerated healing of compromised skin while preventing, reducing or inhibiting scarring for use in general clinical contexts. In some aspects, this can involve the treatment of surgical incisions and application of such methods may result in the prevention, reduction or inhibition of scarring that may otherwise occur on such healing. Such treatment may result in the scars being less noticeable and exhibiting regeneration of a more normal skin structure. In other embodiments, the compromised skin that is treated is not compromised skin that is caused by a surgical incision. The compromised skin may be subject to continued care and continued application of medicaments to encourage re-epithelialisation and healing.

In some aspects, methods associated with the invention may also be used in the treatment of compromised skin associated with grafting procedures. This can involve treatment at a graft donor site and/or at a graft recipient site. Grafts can in some embodiments involve skin, artificial skin, or skin substitutes. Methods associated with the invention can also be used for promoting epithelial regeneration. As used herein, promotion of epithelial regeneration encompasses any increase in the rate of epithelial regeneration as compared to the regeneration occurring in a control-treated or untreated epithelium. The rate of epithelial regeneration attained can in some instances be compared with that taking place in control-treated or untreated epithelia using any suitable model of epithelial regeneration known in the art. Promotion of epithelial regeneration may be of use to induce effective re-epithelialisation in contexts in which the re-epithelialisation response is impaired, inhibited, retarded or otherwise defective. Promotion of epithelial regeneration may be also effected to accelerate the rate of defective or normal epithelial regeneration responses in patients suffering from epithelial damage.

Some instances where re-epithelialisation response may be defective include conditions such as pemphigus, Hailey-Hailey disease (familial benign pemphigus), toxic epidermal necrolysis (TEN)/Lyell's syndrome, epidermolysis bullosa, cutaneous leishmaniasis and actinic keratosis. Defective re-epithelialisation of the lungs may be associated with idiopathic pulmonary fibrosis (IPF) or interstitial lung disease. Defective re-epithelialisation of the eye may be associated with conditions such as partial limbal stem cell deficiency or corneal erosions. Defective re-epithelialisation of the gastrointestinal tract or colon may be associated with conditions such as chronic anal fissures (fissure in ano), ulcerative colitis or Crohn's disease, and other inflammatory bowel disorders.

In some aspects, methods associated with the invention are used to prevent, reduce or otherwise inhibit compromised skin associated with scarring. This can be applied to any site within the body and any tissue or organ, including the skin, eye, nerves, tendons, ligaments, muscle, and oral cavity (including the lips and palate), as well as internal organs (such as the liver, heart, brain, abdominal cavity, pelvic cavity, thoracic cavity, guts and reproductive tissue). In the skin, treatment may change the morphology and organization of collagen fibers and may result in making the scars less visible and blend in with the surrounding skin. As used herein, prevention, reduction or inhibition of scarring encompasses any degree of prevention, reduction or inhibition in scarring as compared to the level of scarring occurring in a control-treated or untreated wound.

Prevention, reduction or inhibition of compromised skin, such as compromised skin associated with dermal scarring, can be assessed and/or measured with reference to microscopic and/or macroscopic characteristics. Macroscopic characteristics may include color, height, surface texture and stiffness of the skin. In some instances, prevention, reduction or inhibition of compromised skin may be demonstrated when the color, height, surface texture and stiffness of the skin resembles that of normal skin more closely after treatment than does a control that is untreated. Microscopic assessment of compromised skin may involve examining characteristics such as thickness and/or orientation and/or composition of the extracellular matrix (ECM) fibers, and cellularity of the compromised skin. In some instances, prevention, reduction or inhibition of compromised skin may be demonstrated when the thickness and/or orientation and/or composition of the extracellular matrix (ECM) fibers, and/or cellularity of the compromised skin resembles that of normal skin more closely after treatment than does a control that is untreated.

In some aspects, methods associated with the invention are used for cosmetic purposes, at least in part to contribute to improving the cosmetic appearance of compromised skin. In some embodiments, methods associated with the invention may be used to prevent, reduce or inhibit compromised skin such as scarring of wounds covering joints of the body. In other embodiments, methods associated with the invention may be used to promote accelerated wound healing and/or prevent, reduce or inhibit scarring of wounds at increased risk of forming a contractile scar, and/or of wounds located at sites of high skin tension.

In some embodiments, methods associated with the invention can be applied to promoting healing of compromised skin in instances where there is an increased risk of pathological scar formation, such as hypertrophic scars and keloids, which may have more pronounced deleterious effects than normal scarring. In some embodiments, methods described herein for promoting accelerated healing of compromised skin and/or preventing, reducing or inhibiting scarring are applied to compromised skin produced by surgical revision of pathological scars.

Aspects of the invention can be applied to compromised skin caused by burn injuries. Healing in response to burn injuries can lead to adverse scarring, including the formation of hypertrophic scars. Methods associated with the invention can be applied to treatment of all injuries involving damage to an epithelial layer, such as injuries to the skin in which the epidermis is damaged. Other non-limiting examples of injuries to epithelial tissue include injuries involving the respiratory epithelia, digestive epithelia or epithelia surrounding internal tissues or organs.

RNAi to Treat Liver Fibrosis

In some embodiments, methods associated with the invention are used to treat liver fibrosis. Liver fibrosis is the excessive accumulation of extracellular matrix proteins, including collagen, that occurs in most types of chronic liver diseases. It is the scarring process that represents the liver's response to injury. Advanced liver fibrosis results in cirrhosis, liver failure, and portal hypertension and often requires liver transplantation. In the same way as skin and other organs heal wounds through deposition of collagen and other matrix constituents so the liver repairs injury through the deposition of new collagen. Activated hepatic stellate cells, portal fibroblasts, and myofibroblasts of bone marrow origin have been identified as major collagen-producing cells in the injured liver. These cells are activated by fibrogenic cytokines such as TGF-β1, angiotensin II, and leptin. In some embodiments, methods provided herein are aimed at inhibiting the accumulation of fibrogenic cells and/or preventing the deposition of extracellular matrix proteins. In some embodiments, RNAi molecules (including sd-rxRNA and rxRNAori) may be designed to target CTGF, TGF-β1, angiotensin II, and/or leptin. In some embodiments, RNAi molecules (including sd-rxRNA and rxRNAori) may be designed to target those genes listed in Tables 1-25.

Trabeculectomy Failure

Trabeculectomy is a surgical procedure designed to create a channel or bleb though the sclera to allow excess fluid to drain from the anterior of the eye, leading to reduced intraocular pressure (IOP), a risk factor for glaucoma-related vision loss. The most common cause of trabeculectomy failure is blockage of the bleb by scar tissue. In certain embodiments, the sd-rxRNA is used to prevent formation of scar tissue resulting from a trabeculectomy. In some embodiments, the sd-rxRNA targets connexin 43. In other embodiments, the sd-rxRNA targets proyly 4-hydroxylase. In yet other embodiments, the sd-rxRNA targets procollagen C-protease.

Target Genes

It should be appreciated that based on the RNAi molecules designed and disclosed herein, one of ordinary skill in the art would be able to design such RNAi molecules to target a variety of different genes depending on the context and intended use. For purposes of pre-treating, treating, or preventing compromised skin and/or promoting wound healing and/or preventing, reducing or inhibiting scarring, one of ordinary skill in the art would appreciate that a variety of suitable target genes could be identified based at least in part on the known or predicted functions of the genes, and/or the known or predicted expression patterns of the genes. Several non-limiting examples of genes that could be targeted by RNAi molecules for pre-treating, treating, or preventing compromised skin and/or promoting wound healing and/or preventing, reducing or inhibiting scarring include genes that encode for the following proteins: Transforming growth factor β (TGFβ1, TGFβ2, TGFβ3), Osteopontin (SPP1), Connective tissue growth factor (CTGF), Platelet-derived growth factor (PDGF), Hypoxia inducible factor-1α (HIF1α), Collagen I and/or III, Prolyl 4-hydroxylase (P4H), Procollagen C-protease (PCP), Matrix metalloproteinase 2, 9 (MMP2, 9), Integrins, Connexin, Histamine H1 receptor, Tissue transglutaminase, Mammalian target of rapamycin (mTOR), HoxB13, VEGF, IL-6, SMAD proteins, Ribosomal protein S6 kinases (RSP6), Cyclooxygenase-2 (COX-2/PTGS2), Cannabinoid receptors (CB1, CB2), and/or miR29b.

Transforming growth factor β proteins, for which three isoforms exist in mammals (TGFβ1, TGFβ2, TGFβ3), are secreted proteins belonging to a superfamily of growth factors involved in the regulation of many cellular processes including proliferation, migration, apoptosis, adhesion, differentiation, inflammation, immuno-suppression and expression of extracellular proteins. These proteins are produced by a wide range of cell types including epithelial, endothelial, hematopoietic, neuronal, and connective tissue cells. Representative Genbank accession numbers providing DNA and protein sequence information for human TGFβ1, TGFβ2 and TGFβ3 are BT007245, BC096235, and X14149, respectively. Within the TGFβ family, TGFβ1 and TGFβ2 but not TGFβ3 represent suitable targets. The alteration in the ratio of TGFβ variants will promote better wound healing and will prevent excessive scar formation.

Osteopontin (OPN), also known as Secreted phosphoprotein 1 (SPP1), Bone Sinaloprotein 1 (BSP-1), and early T-lymphocyte activation (ETA-1) is a secreted glycoprotein protein that binds to hydroxyapatite. OPN has been implicated in a variety of biological processes including bone remodeling, immune functions, chemotaxis, cell activation and apoptosis. Osteopontin is produced by a variety of cell types including fibroblasts, preosteoblasts, osteoblasts, osteocytes, odontoblasts, bone marrow cells, hypertrophic chondrocytes, dendritic cells, macrophages, smooth muscle, skeletal muscle myoblasts, endothelial cells, and extraosseous (non-bone) cells in the inner ear, brain, kidney, deciduum, and placenta. Representative Genbank accession number providing DNA and protein sequence information for human Osteopontin are NM_000582.2 and X13694.

Connective tissue growth factor (CTGF), also known as Hypertrophic chondrocyte-specific protein 24, is a secreted heparin-binding protein that has been implicated in wound healing and scleroderma. Connective tissue growth factor is active in many cell types including fibroblasts, myofibroblasts, endothelial and epithelial cells. Representative Genbank accession number providing DNA and protein sequence information for human CTGF are NM_001901.2 and M92934.

The Platelet-derived growth factor (PDGF) family of proteins, including several isoforms, are secreted mitogens. PDGF proteins are implicated in wound healing, at least in part, because they are released from platelets following wounding. Representative Genbank accession numbers providing DNA and protein sequence information for human PDGF genes and proteins include X03795 (PDGFA), X02811 (PDGFB), AF091434 (PDGFC), AB033832 (PDGFD).

Hypoxia inducible factor-1α (HIF 1α), is a transcription factor involved in cellular response to hypoxia. HIF1α is implicated in cellular processes such as embryonic vascularization, tumor angiogenesis and pathophysiology of ischemic disease. A representative Genbank accession number providing DNA and protein sequence information for human HIF1α is U22431.

Collagen proteins are the most abundant mammalian proteins and are found in tissues such as skin, tendon, vascular, ligature, organs, and bone. Collagen I proteins (such as COL1A1 and COL1A2) are detected in scar tissue during wound healing, and are expressed in the skin. Collagen III proteins (including COL3A1) are detected in connective tissue in wounds (granulation tissue), and are also expressed in skin. Representative Genbank accession numbers providing DNA and protein sequence information for human Collagen proteins include: Z74615 (COL1A1), J03464 (COL1A2) and X14420 (COL3A1).

Prolyl 4-hydroxylase (P4H), is involved in production of collagen and in oxygen sensing. A representative Genbank accession number providing DNA and protein sequence information for human P4H is AY198406.

Procollagen C-protease (PCP) is another target.

Matrix metalloproteinase 2, 9 (MMP2, 9) belong to the metzincin metalloproteinase superfamily and are zinc-dependent endopeptidases. These proteins are implicated in a variety of cellular processes including tissue repair. Representative Genbank accession numbers providing DNA and protein sequence information for human MMP proteins are M55593 (MMP2) and J05070 (MMP9).

Integrins are a family of proteins involved in interaction and communication between a cell and the extracellular matrix. Vertebrates contain a variety of integrins including $\alpha_1\beta_1$, $\alpha_2\beta_1$, $\alpha_4\beta_1$, $\alpha_5\beta_1$, $\alpha_6\beta_1$, $\alpha_L\beta_2$, $\alpha_M\beta_2$, $\alpha_{IIb}\beta_3$, $\alpha_v\beta_3$, $\alpha_v\beta_5$, $\alpha_v\beta_6$, $\alpha_6\beta_4$.

Connexins are a family of vertebrate transmembrane proteins that form gap junctions. Several examples of Connexins, with the accompanying gene name shown in brackets, include Cx23 (GJE1), Cx25 (GJB7), Cx26 (GJB2), Cx29 (GJE1), Cx30 (GJB6), Cx30.2 (GJC3), Cx30.3 (GJB4), Cx31 (GJB3), Cx31.1 (GJB5), Cx31.9 (GJC1/GJD3), Cx32 (GJB1), Cx33 (GJA6), Cx36 (GJD2/GJA9), Cx37 (GJA4), Cx39 (GJD4), Cx40 (GJA5), Cx40.1 (GJD4), Cx43 (GJA1), Cx45 (GJC1/GJA7), Cx46 (GJA3), Cx47 (GJC2/GJA12), Cx50 (GJA8), Cx59 (GJA10), and Cx62 (GJA10).

Histamine H1 receptor (HRH1) is a metabotropic G-protein-coupled receptor involved in the phospholipase C and phosphatidylinositol (PIP2) signaling pathways. A representative Genbank accession number providing DNA and protein sequence information for human HRH1 is Z34897.

Tissue transglutaminase, also called Protein-glutamine gamma-glutamyltransferase 2, is involved in protein crosslinking and is implicated is biological processes such as apoptosis, cellular differentiation and matrix stabilization. A representative Genbank accession number providing DNA and protein sequence information for human Tissue transglutaminase is M55153.

Mammalian target of rapamycin (mTOR), also known as Serine/threonine-protein kinase mTOR and FK506 binding protein 12-rapamycin associated protein 1 (FRAP1), is involved in regulating cell growth and survival, cell motility, transcription and translation. A representative Genbank accession number providing DNA and protein sequence information for human mTOR is L34075.

HoxB13 belongs to the family of Homeobox proteins and has been linked to functions such as cutaneous regeneration and fetal skin development. A representative Genbank accession number providing DNA and protein sequence information for human HoxB13 is U57052.

Vascular endothelial growth factor (VEGF) proteins are growth factors that bind to tyrosine kinase receptors and are implicated in multiple disorders such as cancer, age-related macular degeneration, rheumatoid arthritis and diabetic retinopathy. Members of this protein family include VEGF-A, VEGF-B, VEGF-C and VEGF-D. Representative Genbank accession numbers providing DNA and protein sequence information for human VEGF proteins are M32977 (VEGF-A), U43368 (VEGF-B), X94216 (VEGF-C), and D89630 (VEGF-D).

Interleukin-6 (IL-6) is a cytokine involved in stimulating immune response to tissue damage. A representative Genbank accession number providing DNA and protein sequence information for human IL-6 is X04430.

SMAD proteins (SMAD1-7, 9) are a family of transcription factors involved in regulation of TGFβ signaling. Representative Genbank accession numbers providing DNA and protein sequence information for human SMAD proteins are U59912 (SMAD1), U59911 (SMAD2), U68019 (SMAD3), U44378 (SMAD4), U59913 (SMAD5), U59914 (SMAD6), AF015261 (SMAD7), and BC011559 (SMAD9).

Ribosomal protein S6 kinases (RSK6) represent a family of serine/threonine kinases involved in activation of the transcription factor CREB. A representative Genbank accession number providing DNA and protein sequence information for human Ribosomal protein S6 kinase alpha-6 is AF184965.

Cyclooxygenase-2 (COX-2), also called Prostaglandin G/H synthase 2 (PTGS2), is involved in lipid metabolism and biosynthesis of prostanoids and is implicated in inflammatory disorders such as rheumatoid arthritis. A representative Genbank accession number providing DNA and protein sequence information for human COX-2 is AY462100.

Cannabinoid receptors, of which there are currently two known subtypes, CB 1 and CB2, are a class of cell membrane receptors under the G protein-coupled receptor superfamily. The CB 1 receptor is expressed mainly in the brain, but is also expressed in the lungs, liver and kidneys, while the CB2 receptor is mainly expressed in the immune system and in hematopoietic cells. A representative Genbank accession number providing DNA and protein sequence information for human CB 1 is NM_001160226, NM_001160258, NM_001160259, NM_001160260, NM_016083, and NM_033181.

miR29b (or miR-29b) is a microRNA (miRNA), which is a short (20-24 nt) non-coding RNA involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. A representative miRBase accession number for miR29b is MI0000105 (website: mirbase.org/cgi-bin/mirna_entry.pl?acc=MI0000105).

In some embodiments, the sd-rxRNA targets connexin 43 (CX43). This gene is a member of the connexin gene family. The encoded protein is a component of gap junctions, which are composed of arrays of intercellular channels that provide a route for the diffusion of low molecular weight materials from cell to cell. The encoded protein is the major protein of gap junctions in the heart that are thought to have a crucial role in the synchronized contraction of the heart and in embryonic development. A related intronless pseudogene has been mapped to chromosome 5. Mutations in this gene have been associated with oculodentodigital dysplasia and heart malformations. Representative Genbank accession numbers providing DNA and protein sequence information for human CX43 genes and proteins include NM_000165 and NP_000156.

In other embodiments, the sd-rxRNA targets prolyl 4-hydroxylase (P4HTM). The product of this gene belongs to the family of prolyl 4-hydroxylases. This protein is a prolyl hydroxylase that may be involved in the degradation of hypoxia-inducible transcription factors under normoxia. It plays a role in adaptation to hypoxia and may be related to cellular oxygen sensing. Alternatively spliced variants encoding different isoforms have been identified. Representative Genbank accession numbers providing DNA and protein sequence information for human P4HTM genes and proteins include NM_177938, NP_808807, NM_177939, and NP_808808.

In certain embodiments, the sd-rxRNA targets procollagen C-protease.

EXAMPLES

Example 1

In Vivo Gene Silencing in Skin after Local Delivery of sd-rxRNA

Demonstrated herein is gene silencing in skin following administration of sd-rxRNA molecules. Rat incision models were used which included 6 dorsal incisions per animal. Analysis included monitoring of digital images, detection of target gene expression, scar assessment, and histology. FIG. 1 reveals an expression profile of several genes including MAP4K4, SPP1, CTGF, PTGS2 and TGFB1. As expected, when expression of these genes was monitored post-incision, target gene expression was elevated early and then returned to normal by day 10.

FIG. 2 presents an overview of intradermal injection experiments with sd-rxRNA molecules. 6 intradermal injections were performed at each site. Each injection consisted of approximately 34μ, 300 μg total. Images were taken before injection and 15 minutes after the first injection.

FIG. 3 demonstrates in vivo silencing following intradermal injection of sd-rxRNA in rats. 6 injections were made per dose. 300 μg in PBS was injected on days 1 & 2 (2 doses) or on day 2 (1 dose). 5 incisions sites were made per treatment. Incisions were 1 cm. 3 mm skin biopsies were harvested 48 hours after the last dose and target expression was determined by QPCR.

Figure 4:
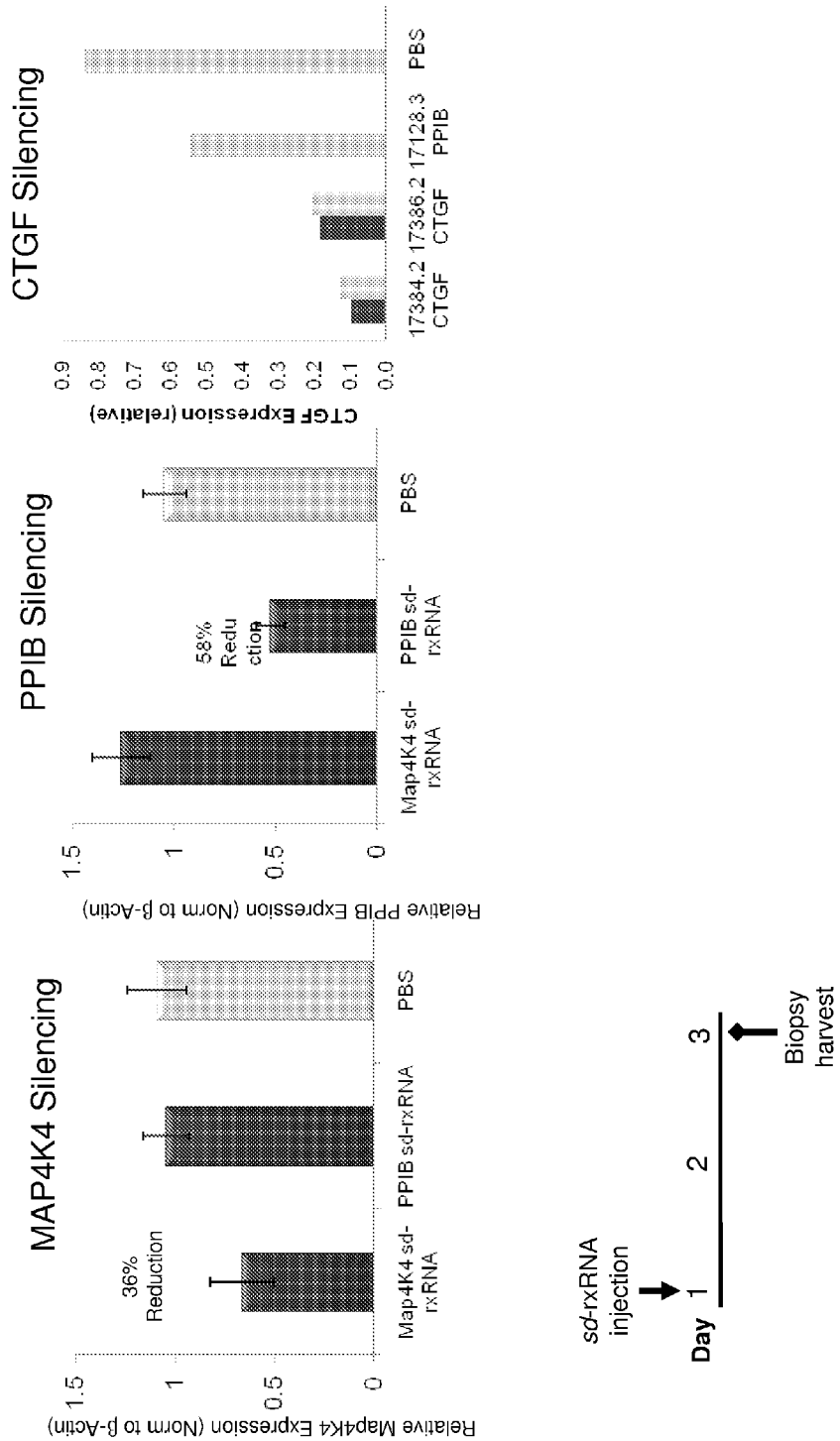
FIG. 4 demonstrates silencing of MAP4K4, PPIB and CTGF following intradermal injection of sd-rxRNA molecules targeting each gene.

FIG. 4 demonstrates in vivo silencing of MAP4K4, PPIB and CTGF expression in rats following intradermal injection of sd-rxRNA molecules. A single intradermal injection of PBS (vehicle), or 300 ug of MAP4K4, or 2 different CTGF or PPIB targeting sd-rxRNA were injected at 6 sites. 3 mm skin biopsies harvested 48 hours post injection and processed for RNA. Data was analyzed by QPCR and normalized to B-Actin. PBS was set to 1. Data was graphed as a percent reduction in targeted gene expression relative to non-targeting sd-rxRNA (i.e. targeting other gene). Gene expression from untreated skin samples on treated animals are similar to PBS treated or sham controls.

FIG. 5 demonstrates in vivo silencing in mice following intradermal injection of sd-rxRNA molecules. C57BL/6 mice were used, with n=7 wheal sites active and PBS. The control group consisted of 12. 300 ug was administered in 50 ul/injections. 3 mm biopsies were processed for RNA, and target expression determined by QPCR. Expression was normalized to housekeeping gene cyclophilin B.

FIG. 6 reveals the in vitro potency and in vivo effectiveness of 2 different sd-rxRNAs targeting PPIB. Two PPIB sd-rxRNAs with different EC50s were compared in vivo. Similar in vivo results were obtained with 1 injection of 300 μg FIGS. 7 and 8 demonstrate the duration of gene silencing achieved through administration of sd-rxRNA. There were 6 injection sites per animal. 3 mm skin biopsies were harvested on days 3, 5, and 8. RNA was isolated and gene expression was analyzed by qPCR and normalized to B-Actin FIG. 9 compares two different dosage regimens, Days 1 and 3 vs. Days 0 and 2. There were 6 injection sites per animal. 3 mm skin biopsies were harvested on days 3, 5, and 8. RNA was isolated and gene expression was analyzed by qPCR and normalized to B-Actin.

Example 2

Identification of Potent sd-rxRNAs

Up to 300 rxRNA on compounds were screened for 5 anti-scarring targets. Optimal sequences in SPP1, CTGF, PTGS2, TGFB1 and TGFB2 for sd-rxRNA development were identified using a sequence selection algorithm. The algorithm selects sequences based on the following criteria: a GC content greater than 32% but less than 47%, homology to specific animal models (e.g., mouse or rat), avoidance of 5 or more U/U stretches and/or 2 or more G/C stretches, an off-target hit score of less than 500, and avoidance of sequences contained within the 5' UTR.

The sequences were developed initially as 25 nucleotide blunt-ended duplexes with O-methyl modification. Such sequences were screened in various cell lines to identify those were most efficient in reducing gene expression. Several concentrations of the RNA molecules, such as 0.025, 0.1 and 0.25 nM, were tested, and suitable concentrations to screen for bDNA were determined. A bDNA was then run of a full screen at a desired concentration. Dose response curves were generated to determine the most potent sequences. Hyperfunctional hits were those with an EC50 of less than 100 pM in lipid transfection. Potent molecules were selected to be developed into sd-rxRNAs based on the parameters described throughout the application and a secondary screen was conducted using the sd-rxRNAs.

Figure 10:
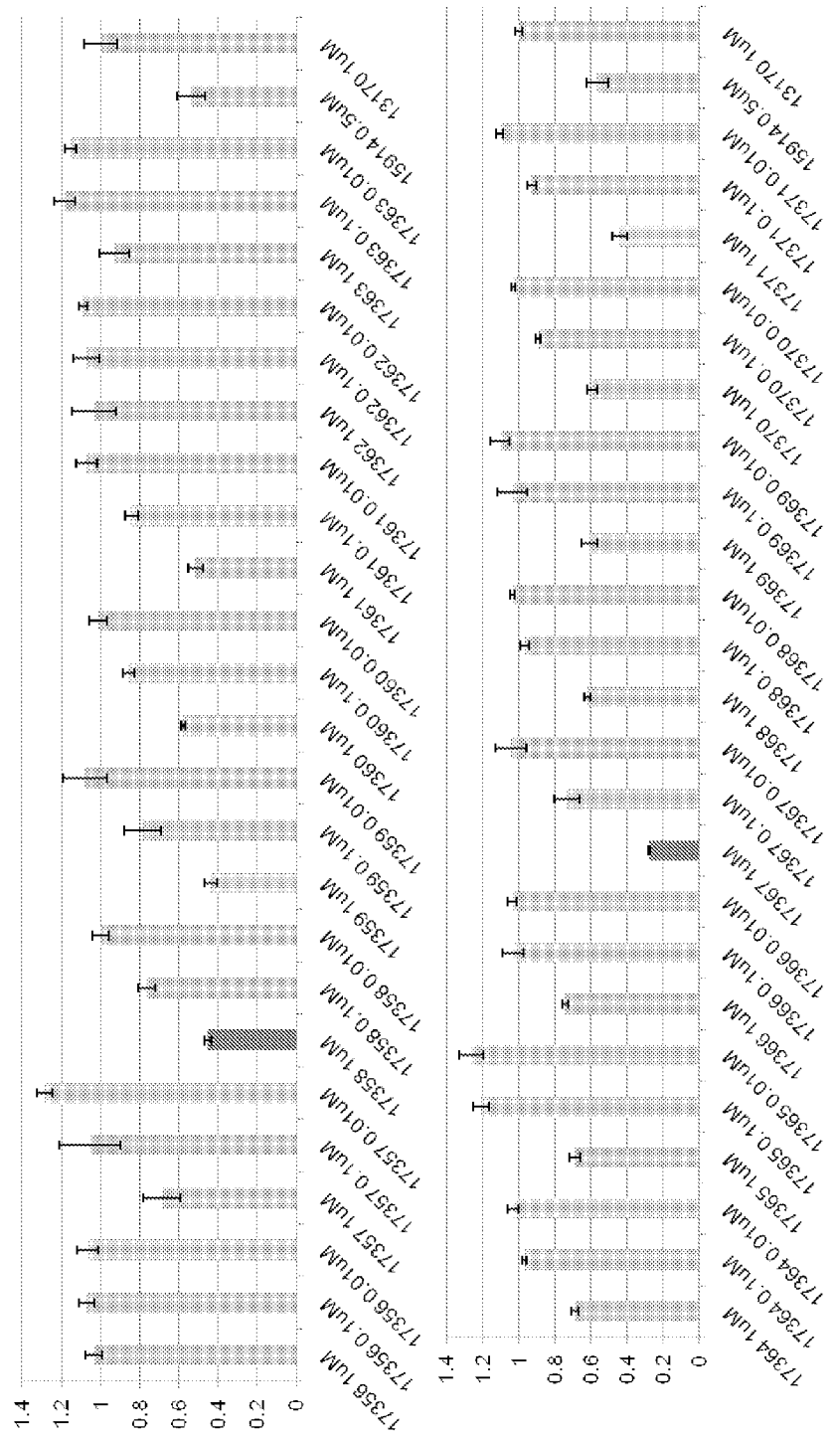
FIG. 10 demonstrates examples of sd-rxRNA molecules targeting CTGF that are efficacious for gene silencing.
Figure 11:
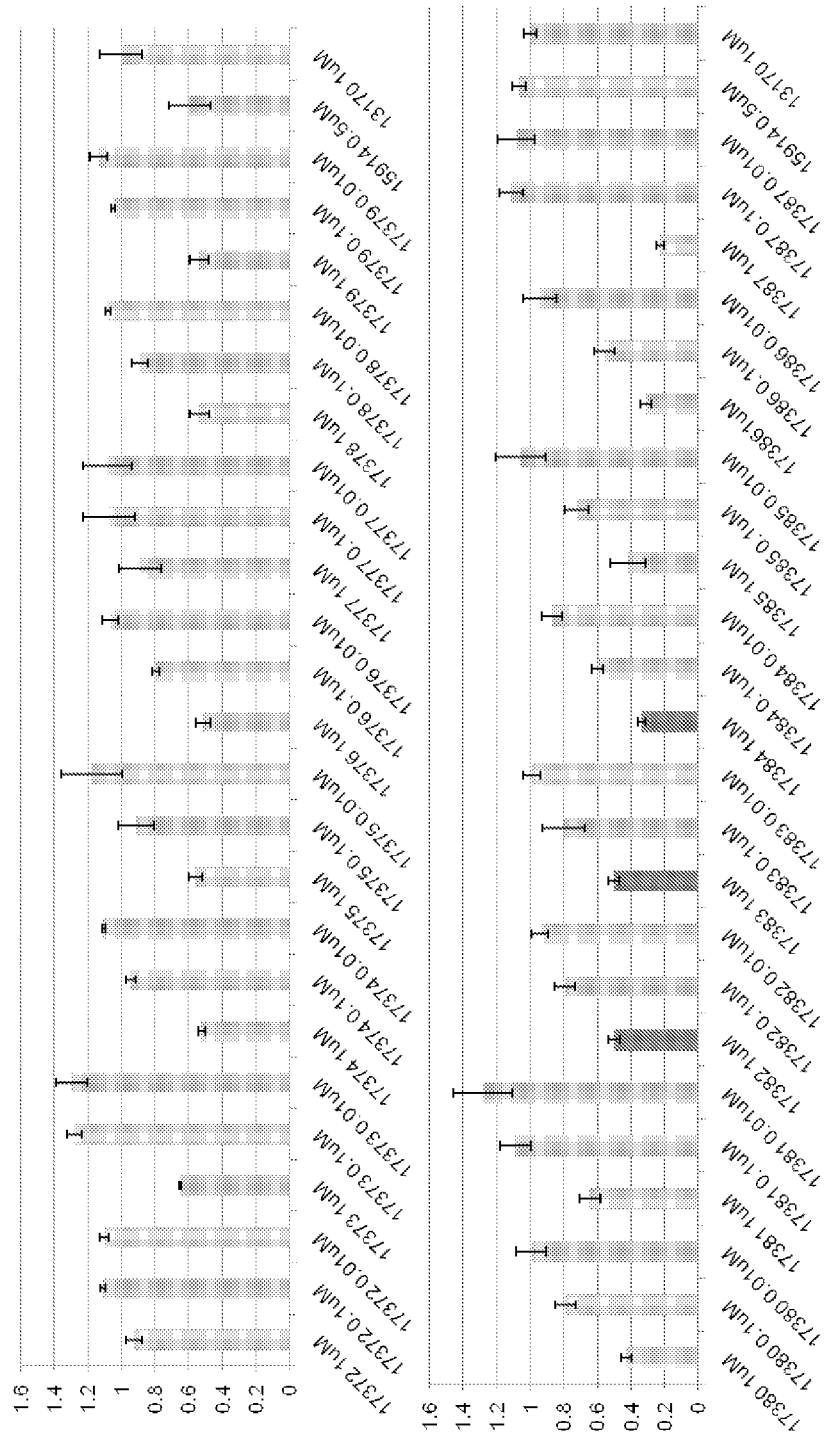
FIG. 11 demonstrates examples of sd-rxRNA molecules targeting CTGF that are efficacious for gene silencing.

FIGS. 10-12 reveal that CTGF sd-rxRNAs are efficacious in mediating gene silencing. A dose response for CTGF is indicated in FIG. 12.

Figure 13:
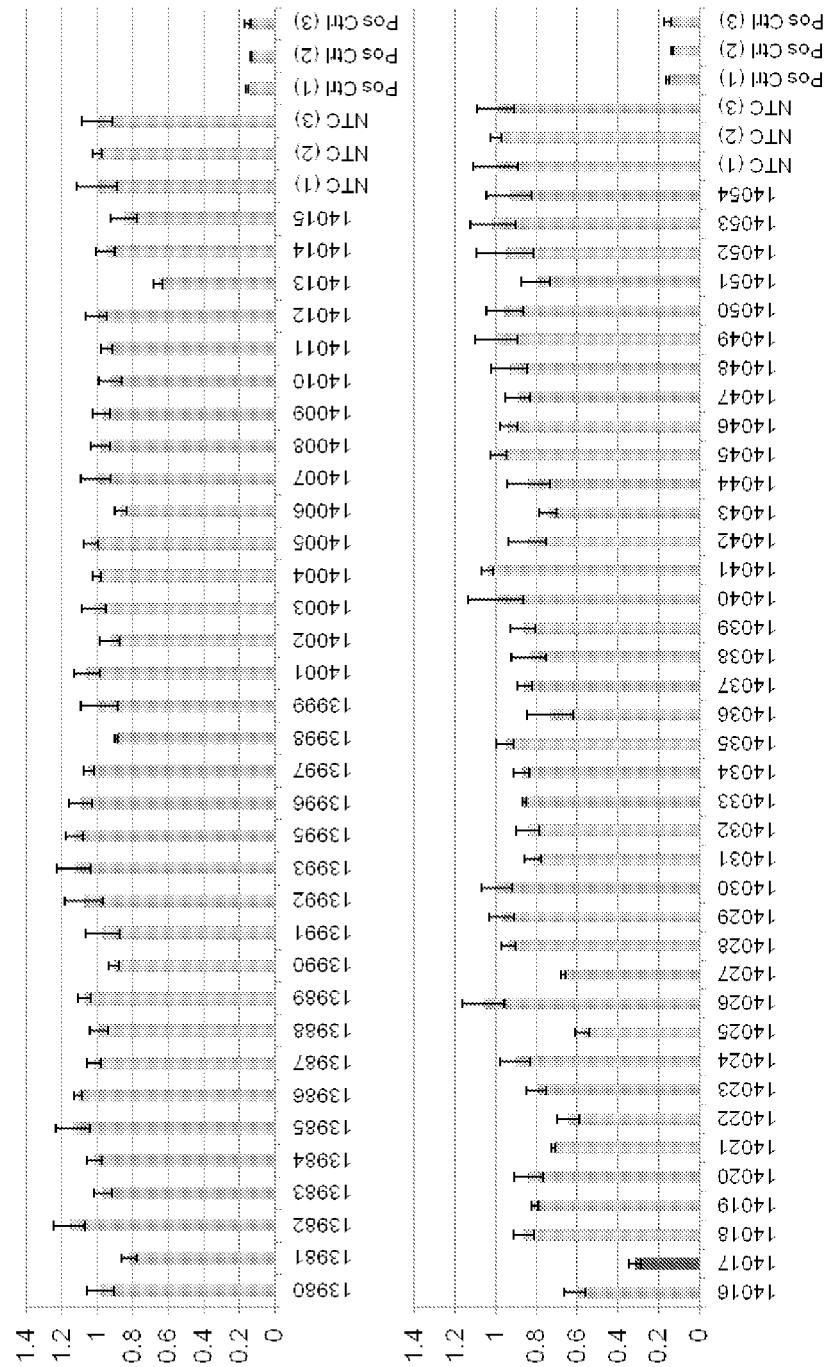
FIG. 13 demonstrates a sample of an original sd-rxRNA screen.
Figure 14:
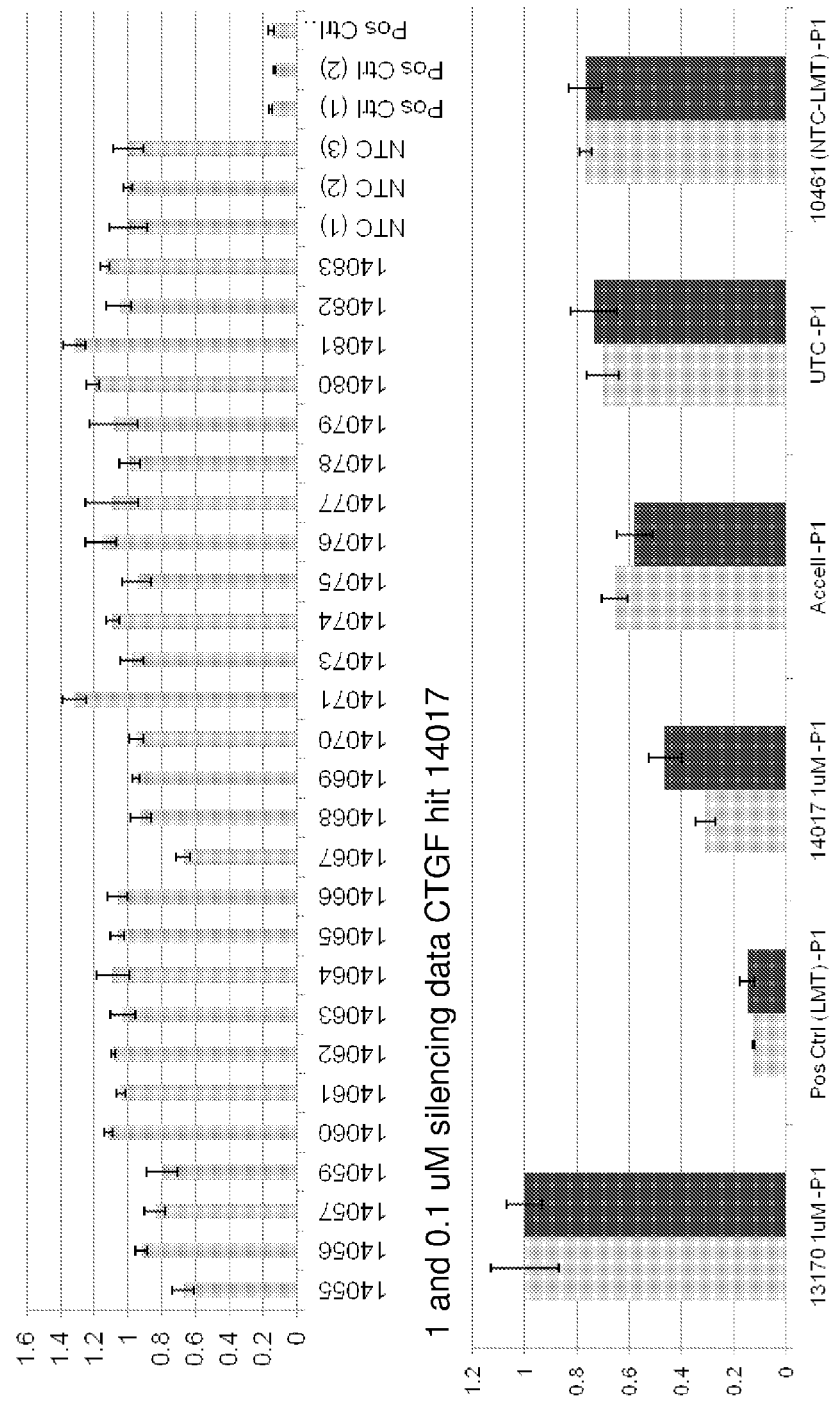
FIG. 14 presents data on a hit from the original sd-rxRNA screen.
Figure 15:
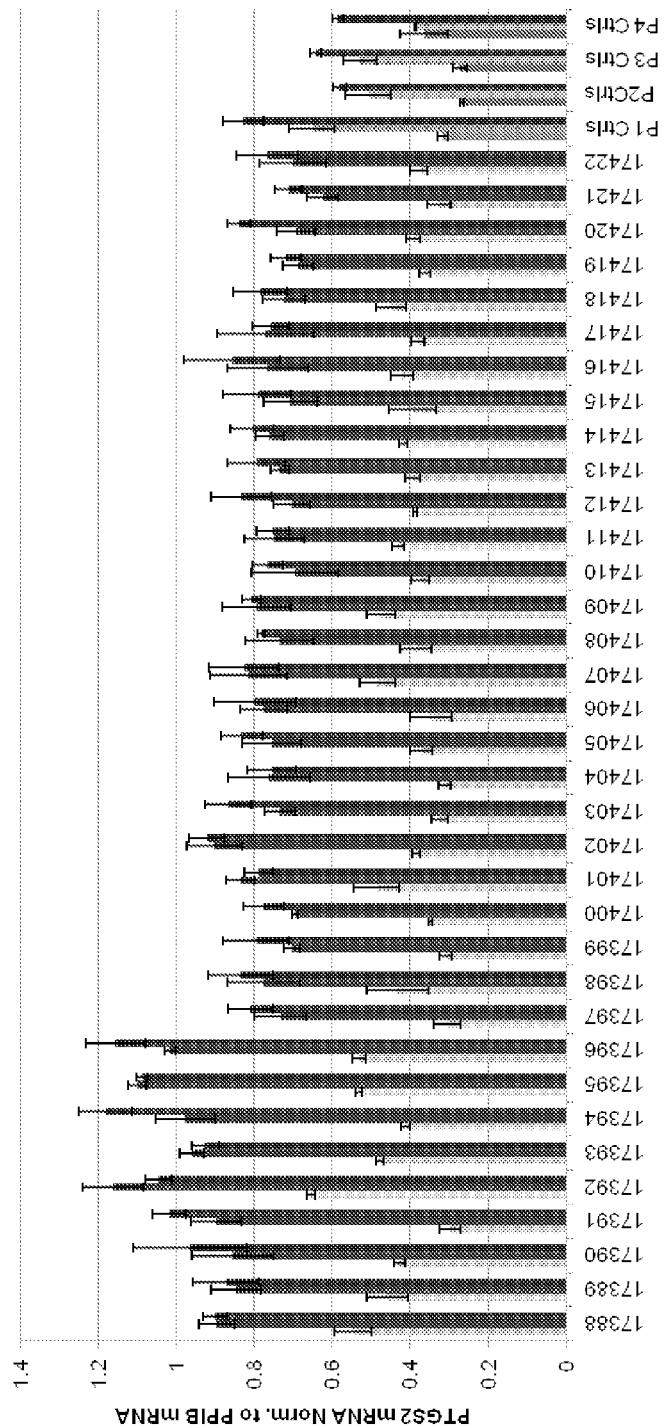
FIG. 15 demonstrates gene expression of PTGS2 following administration of sd-rxRNA targeting PTGS2.
Figure 16:
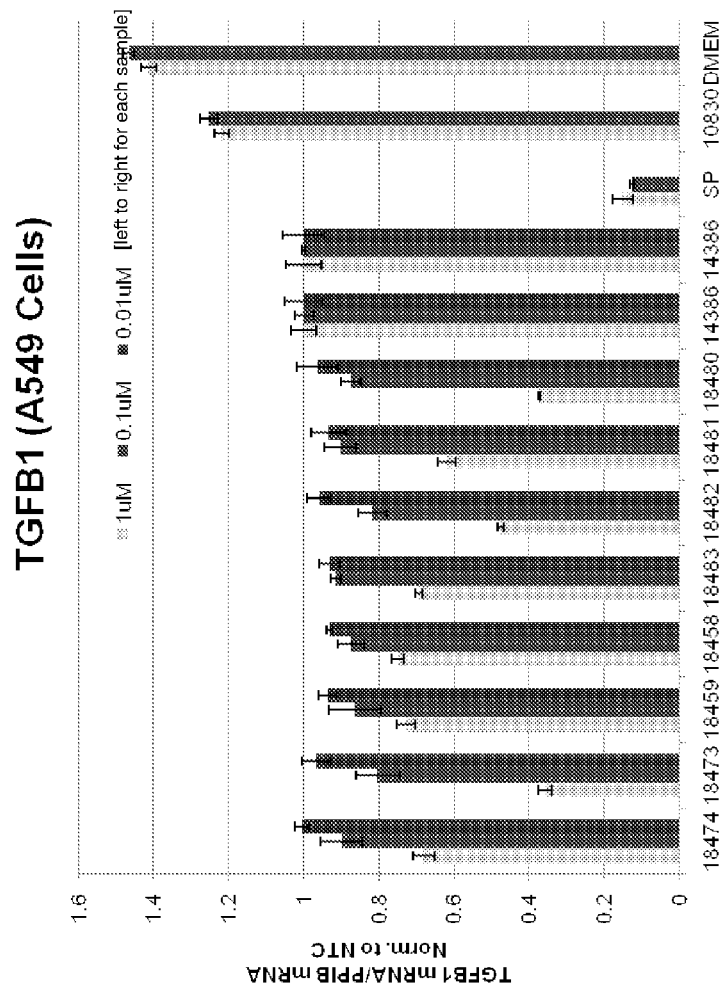
FIG. 16 demonstrates gene expression of hTGFB1 following administration of sd-rxRNA targeting hTGFB1.
Figure 17:
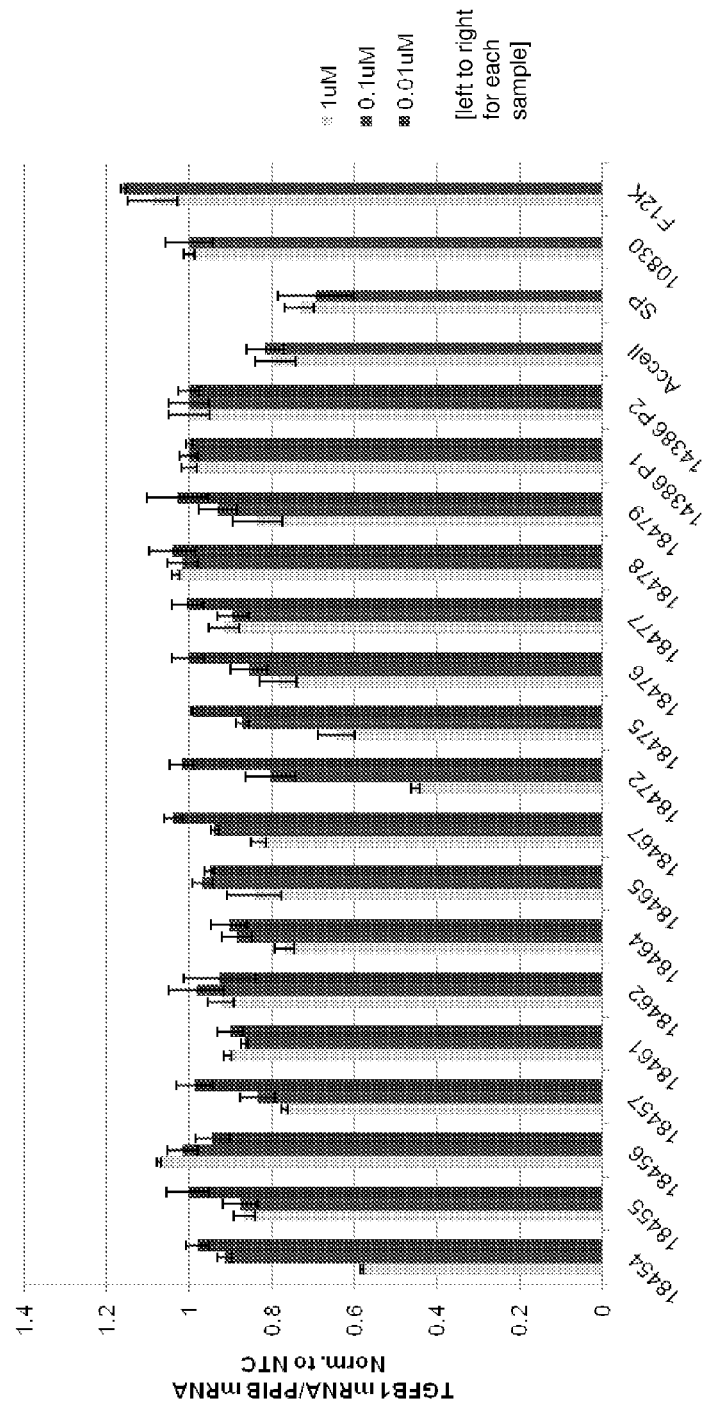
FIG. 17 demonstrates gene expression of hTGFB1 following administration of sd-rxRNA targeting hTGFB1.
Figure 18:
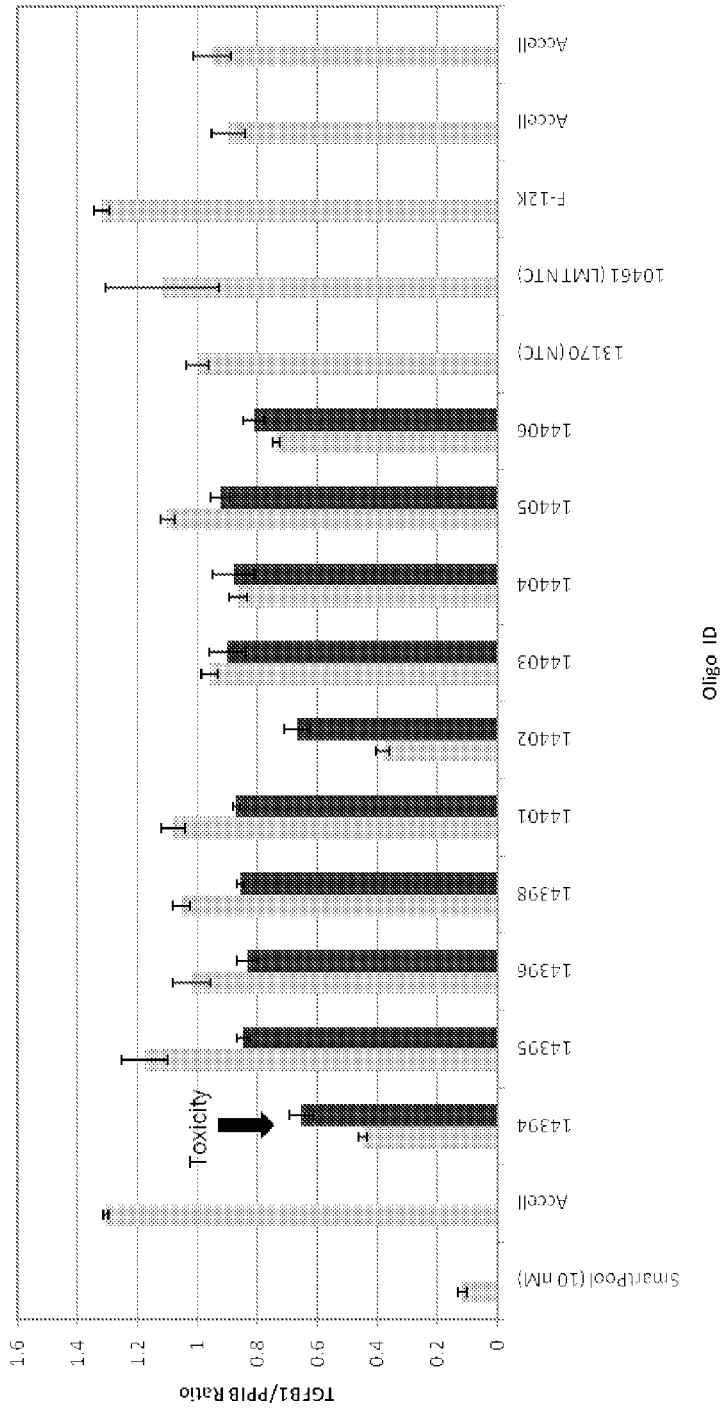
FIG. 18 demonstrates results of TGFB1 sd-rxRNA screening.
Figure 19:
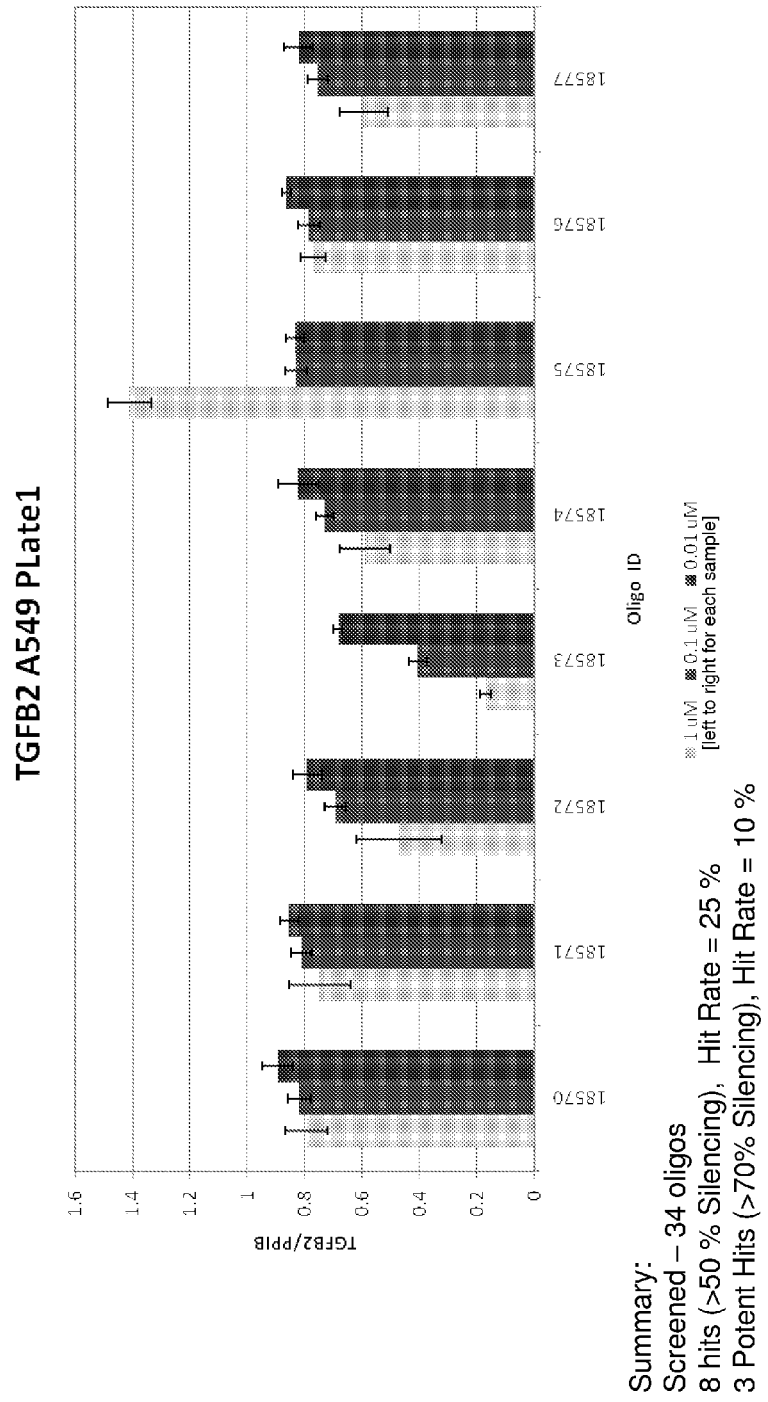
FIG. 19 demonstrates gene expression of TGFB2 following administration of sd-rxRNA targeting TGFB2.
Figure 20:
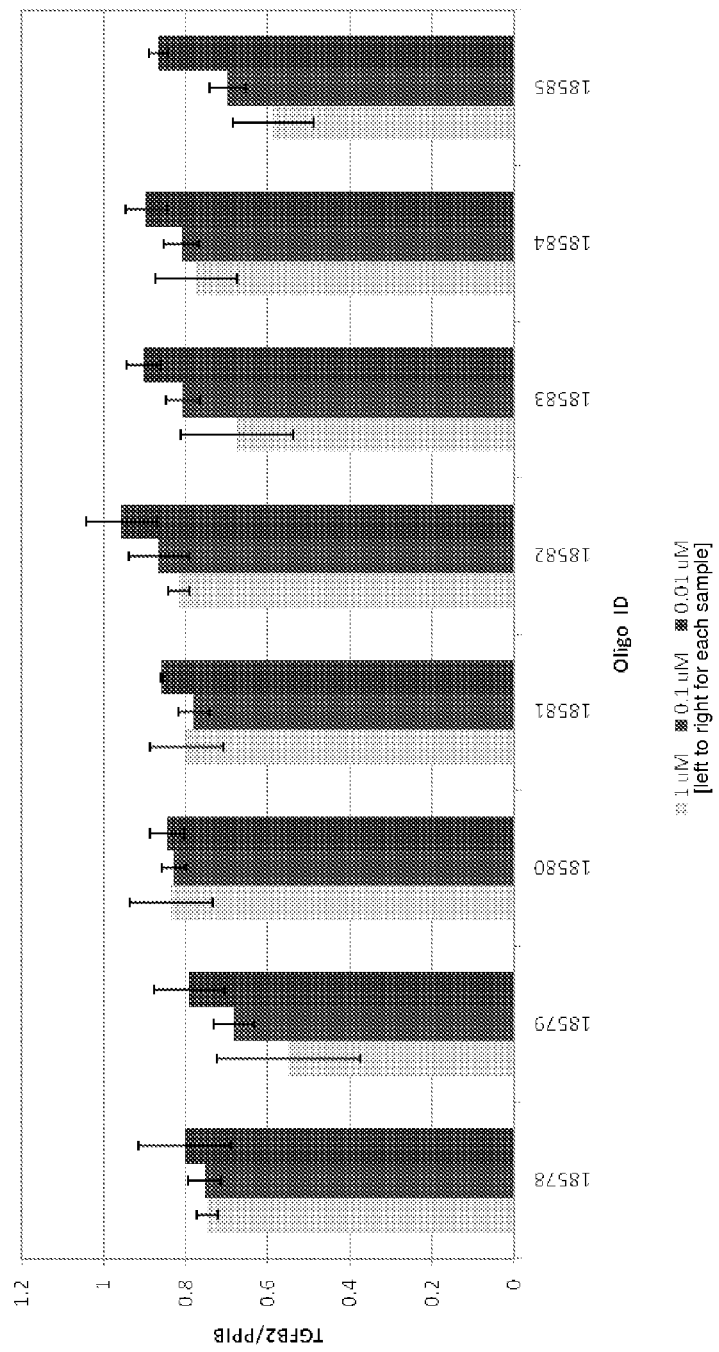
FIG. 20 demonstrates gene expression of TGFB2 following administration of sd-rxRNA targeting TGFB2.
Figure 21:
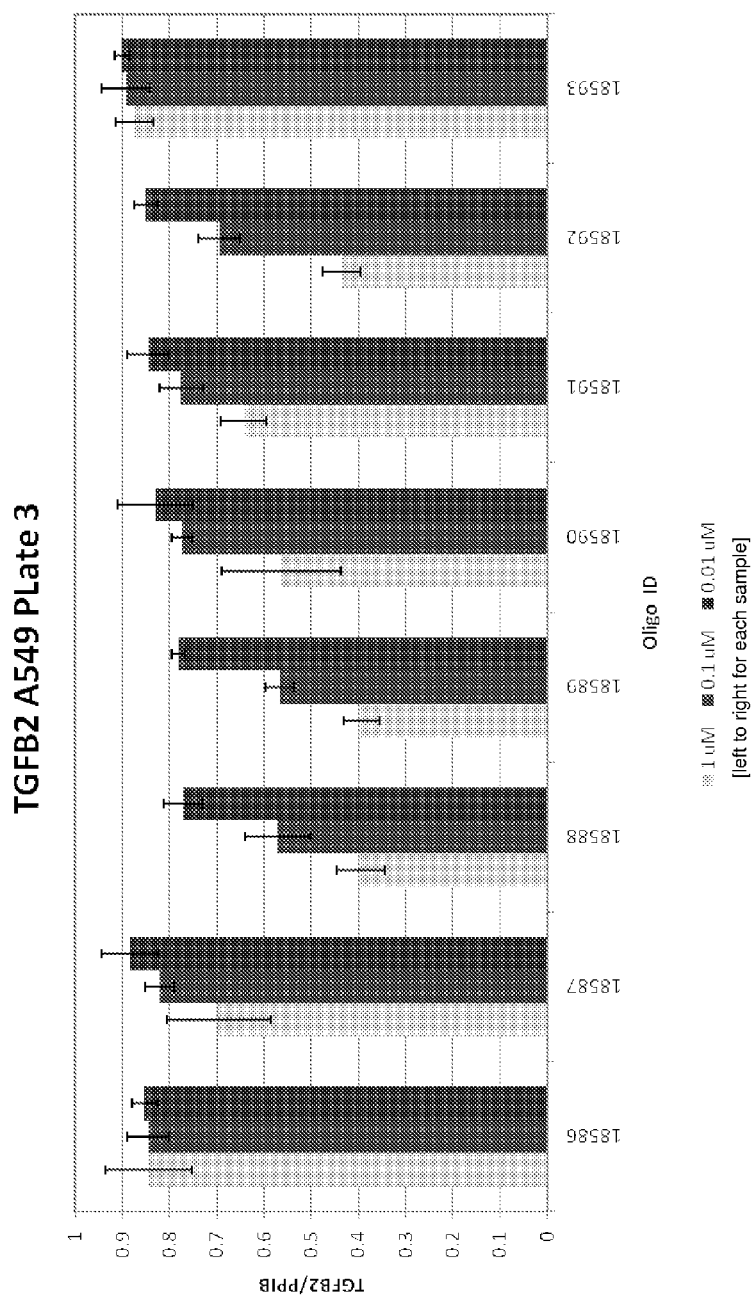
FIG. 21 demonstrates gene expression of TGFB2 following administration of sd-rxRNA targeting TGFB2.
Figure 22:
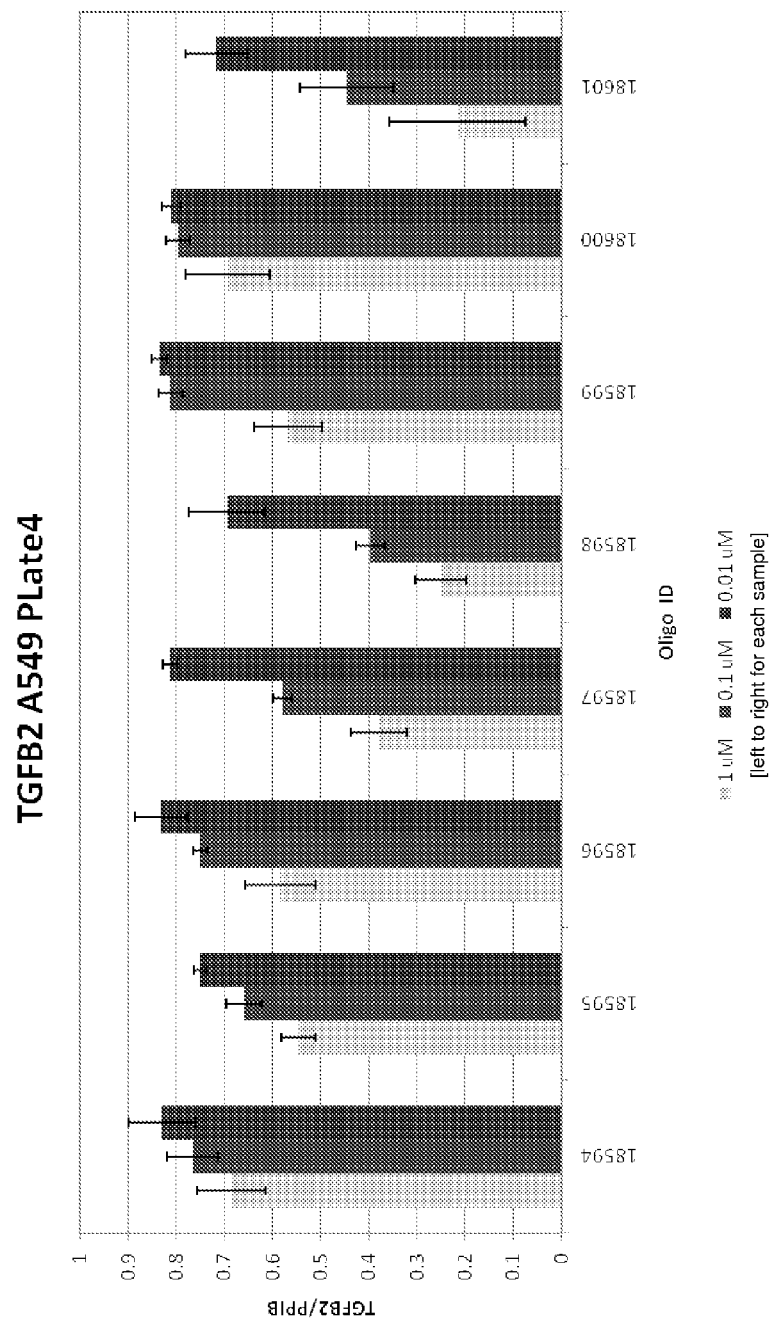
FIG. 22 demonstrates gene expression of TGFB2 following administration of sd-rxRNA targeting TGFB2.
Figure 23:
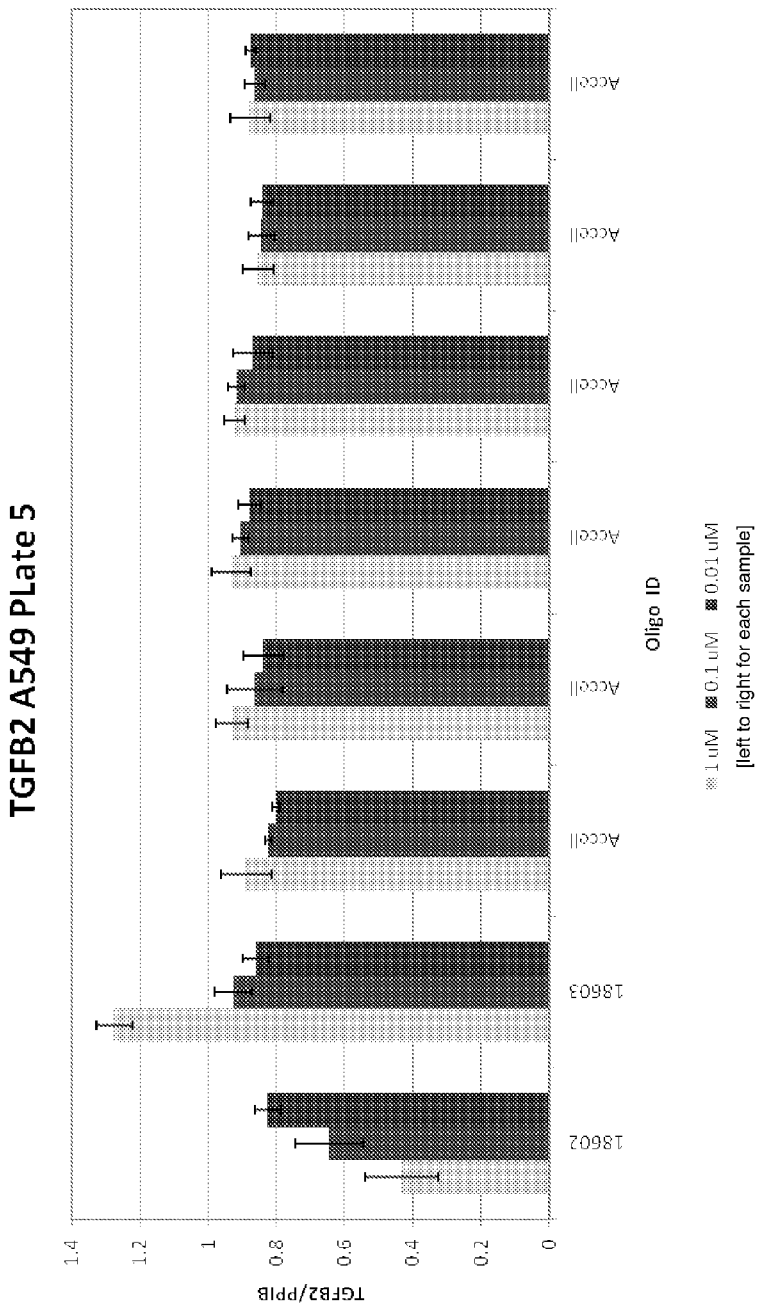
FIG. 23 demonstrates gene expression of TGFB2 following administration of sd-rxRNA targeting TGFB2.
Figure 24:
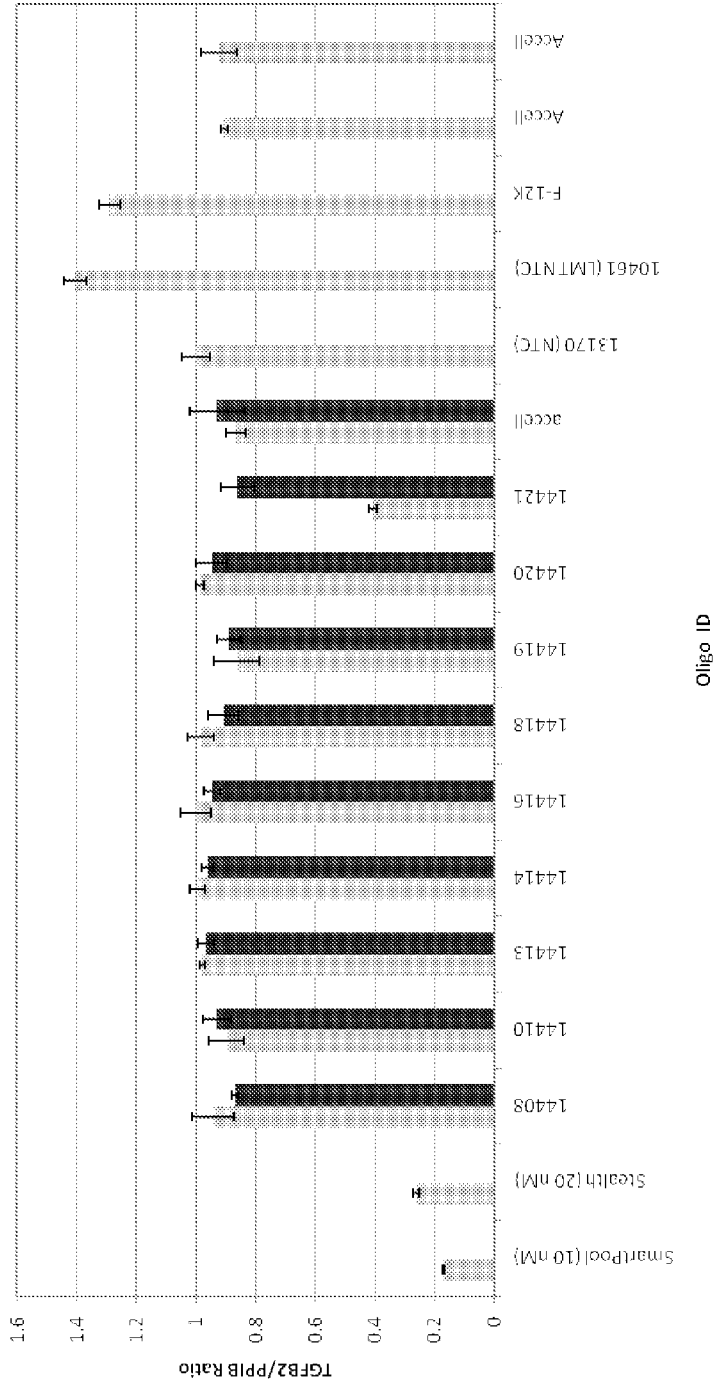
FIG. 24 demonstrates results of TGFB2 sd-rxRNA screening.
Figure 25:
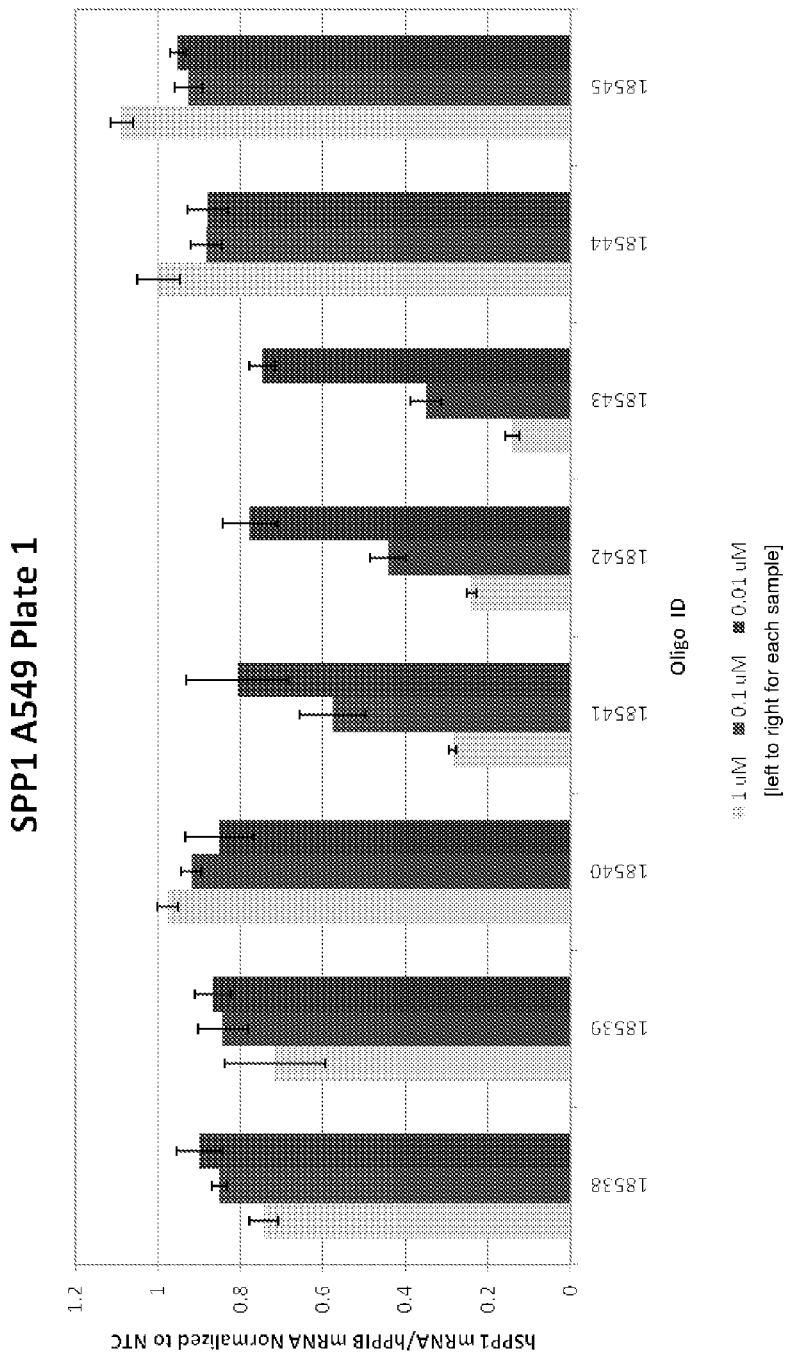
FIG. 25 demonstrates identification of potent hSPP1 sd-rxRNAs.
Figure 26:
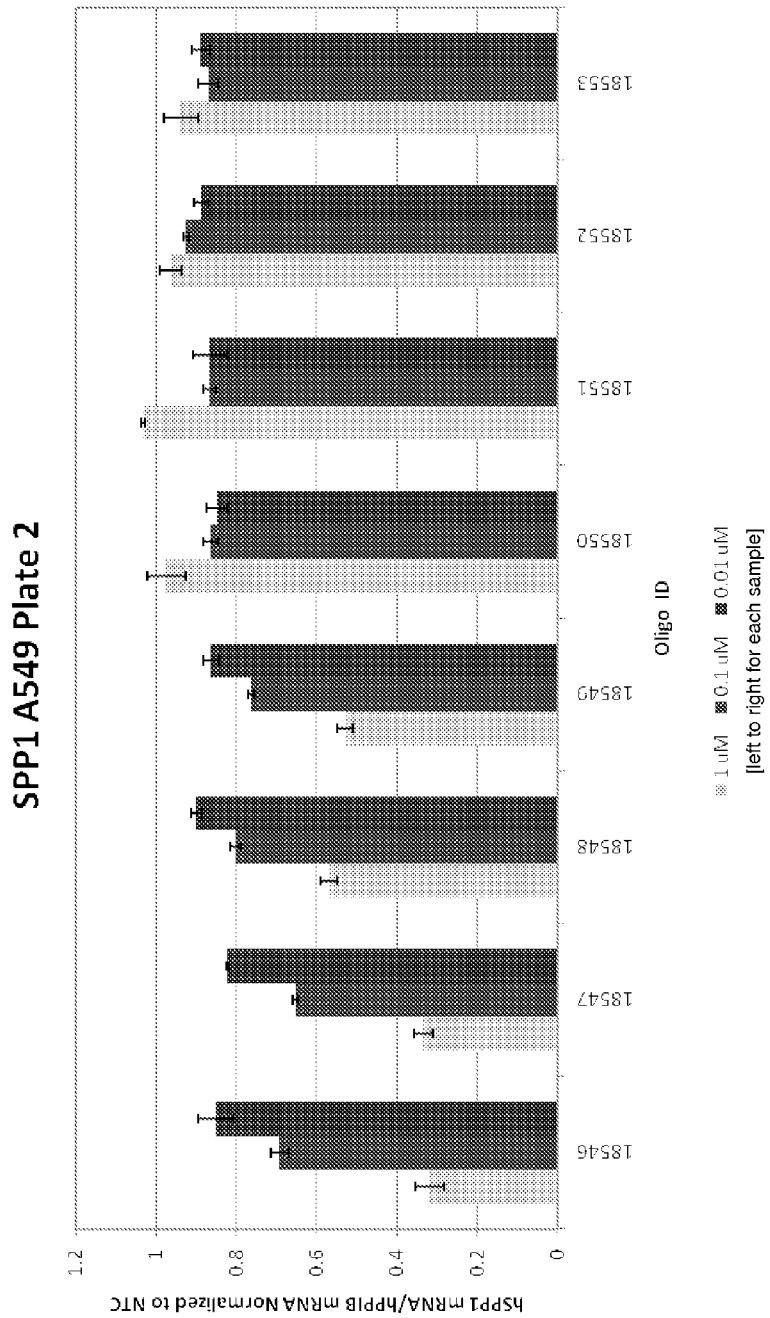
FIG. 26 demonstrates identification of potent hSPP1 sd-rxRNAs.
Figure 27:
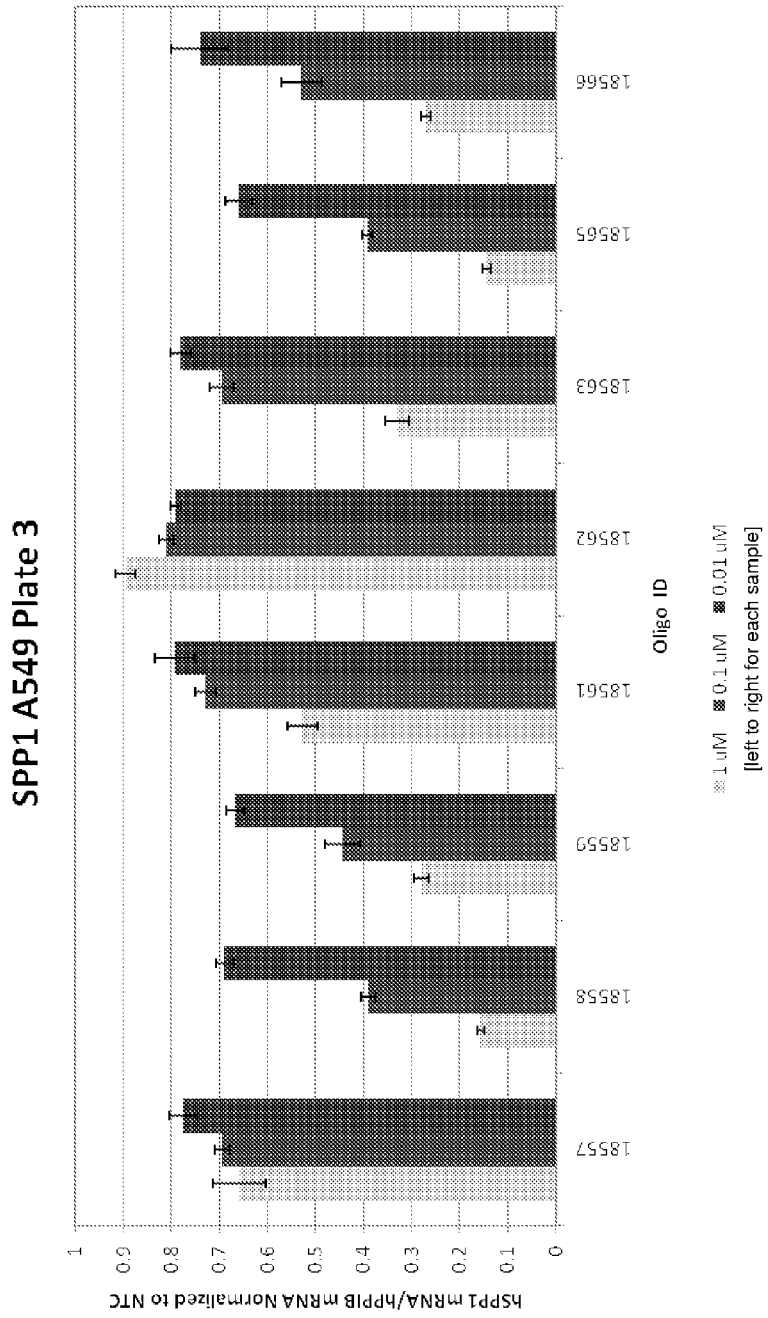
FIG. 27 demonstrates identification of potent hSPP1 sd-rxRNAs.
Figure 28:
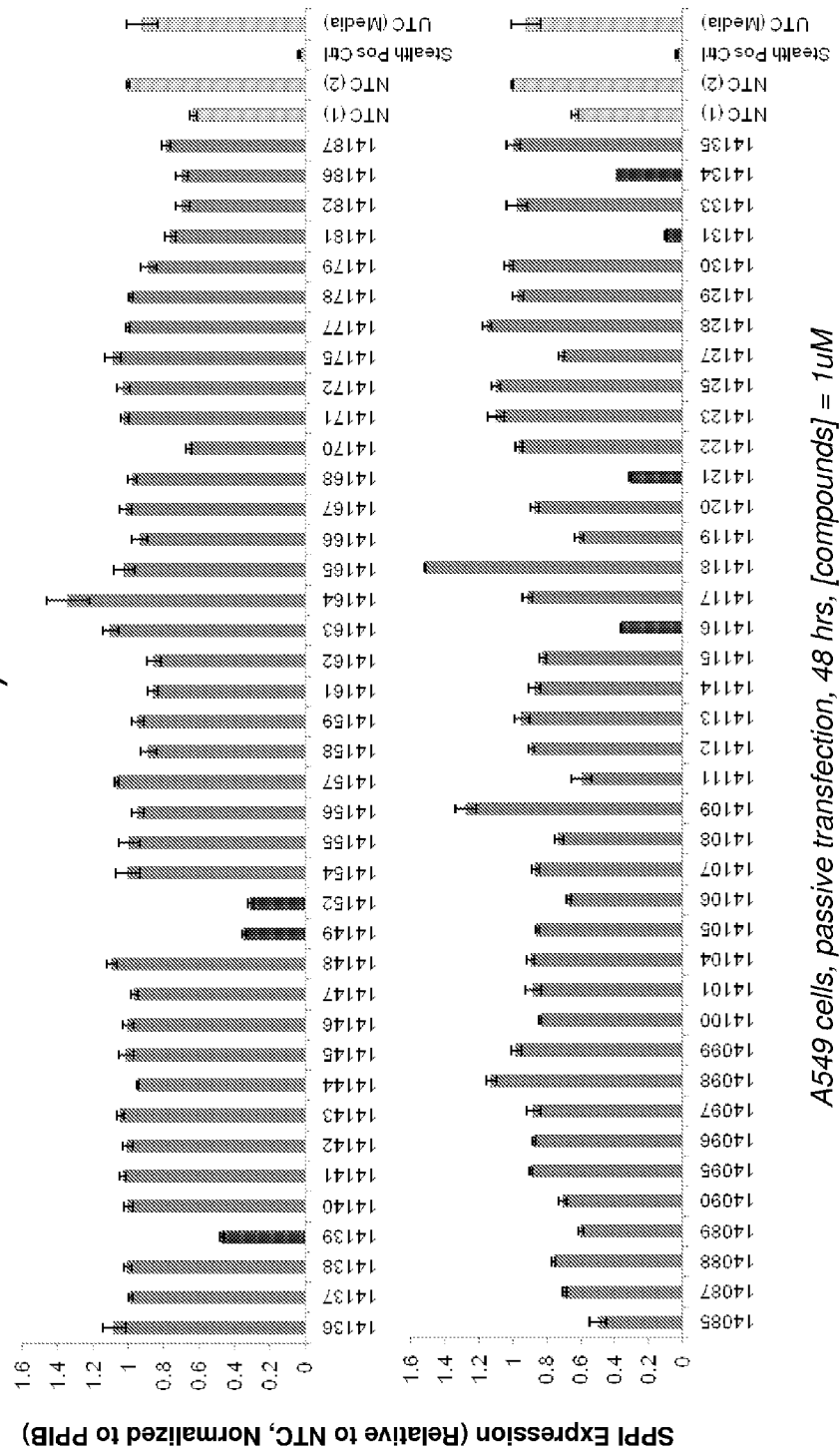
FIG. 28 demonstrates SPP1 sd-rxRNA compound selection.
Figure 29:
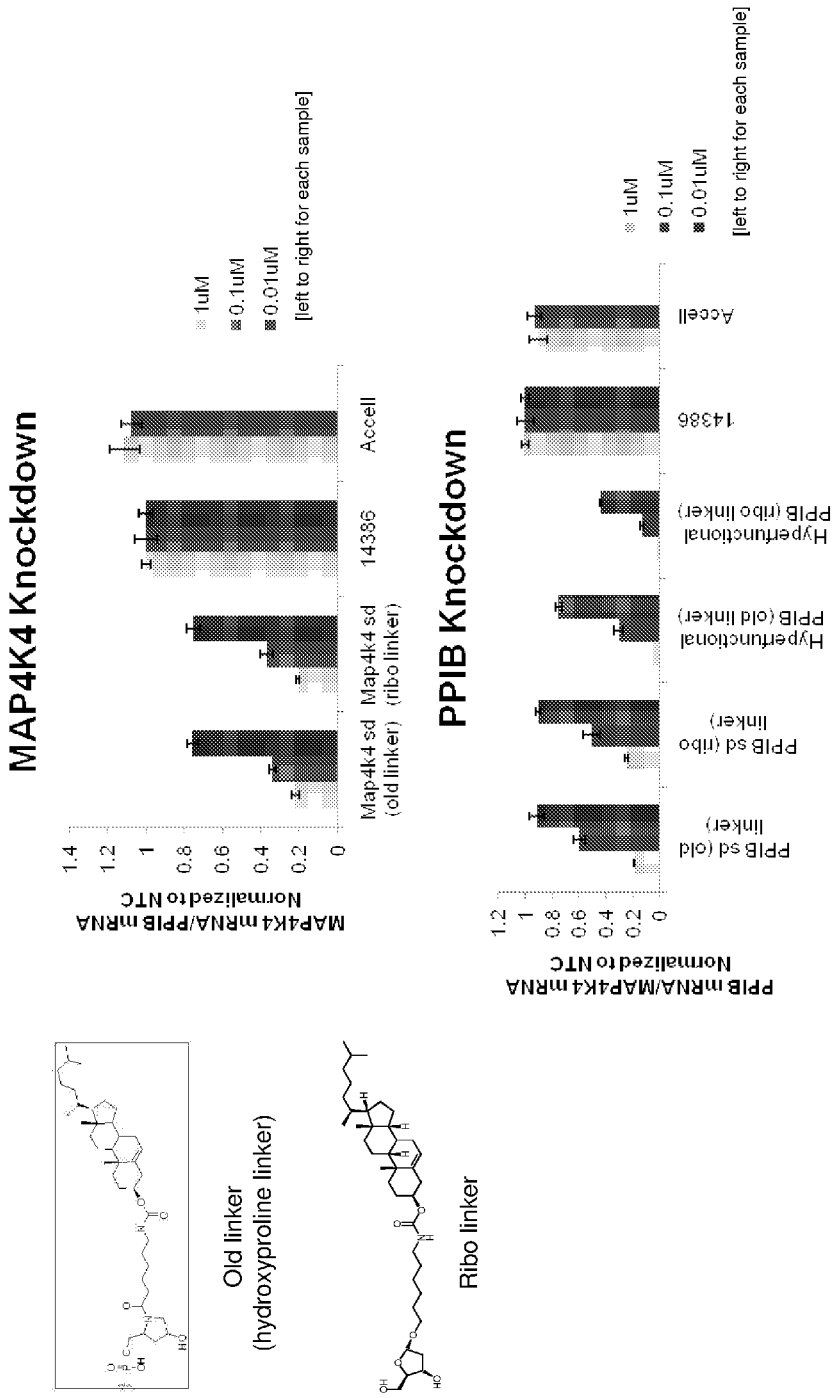
FIG. 29 demonstrates that variation of linker chemistry does not influence silencing activity of sd-rxRNAs in vitro. Two different linker chemistries were evaluated, a hydroxyproline linker and ribo linker, on multiple sd-rxRNAs (targeting Map4k4 or PPIB) in passive uptake assays to determine linkers which favor self delivery. HeLa cells were transfected in the absence of a delivery vehicle (passive transfection) with sd-rxRNAs at 1 uM, 0.1 uM or 0.01 uM for 48 hrs. Use of either linker results in an efficacious delivery of sd-rxRNA.
Figure 30:
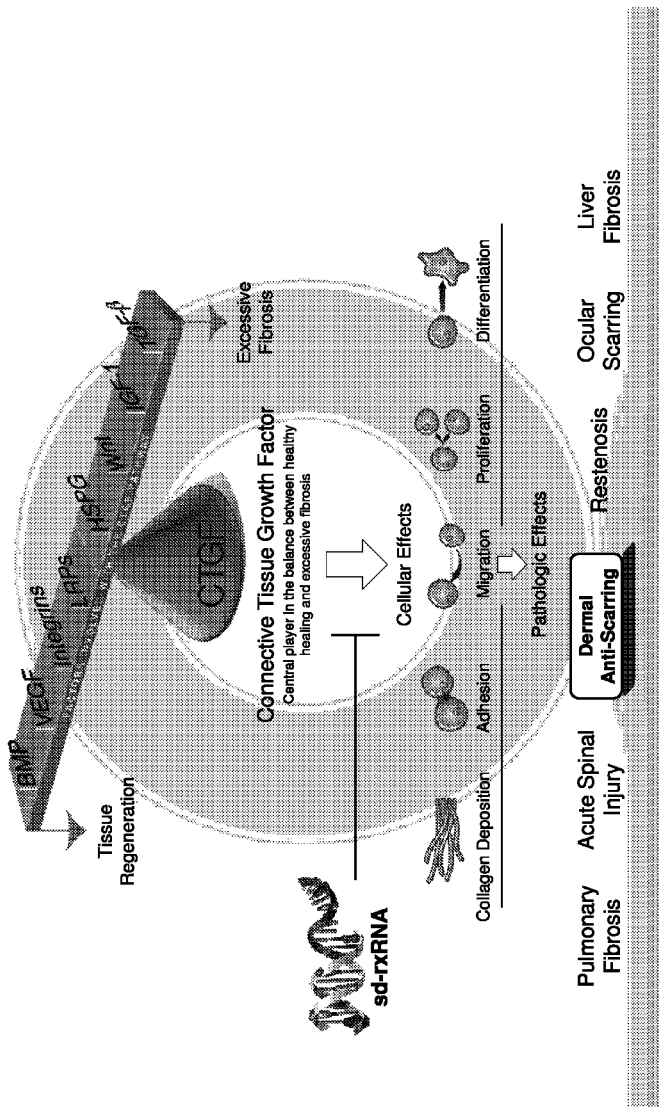
FIG. 30 depicts CTGF as a central factor in the pathway to fibrosis.
Figure 31:
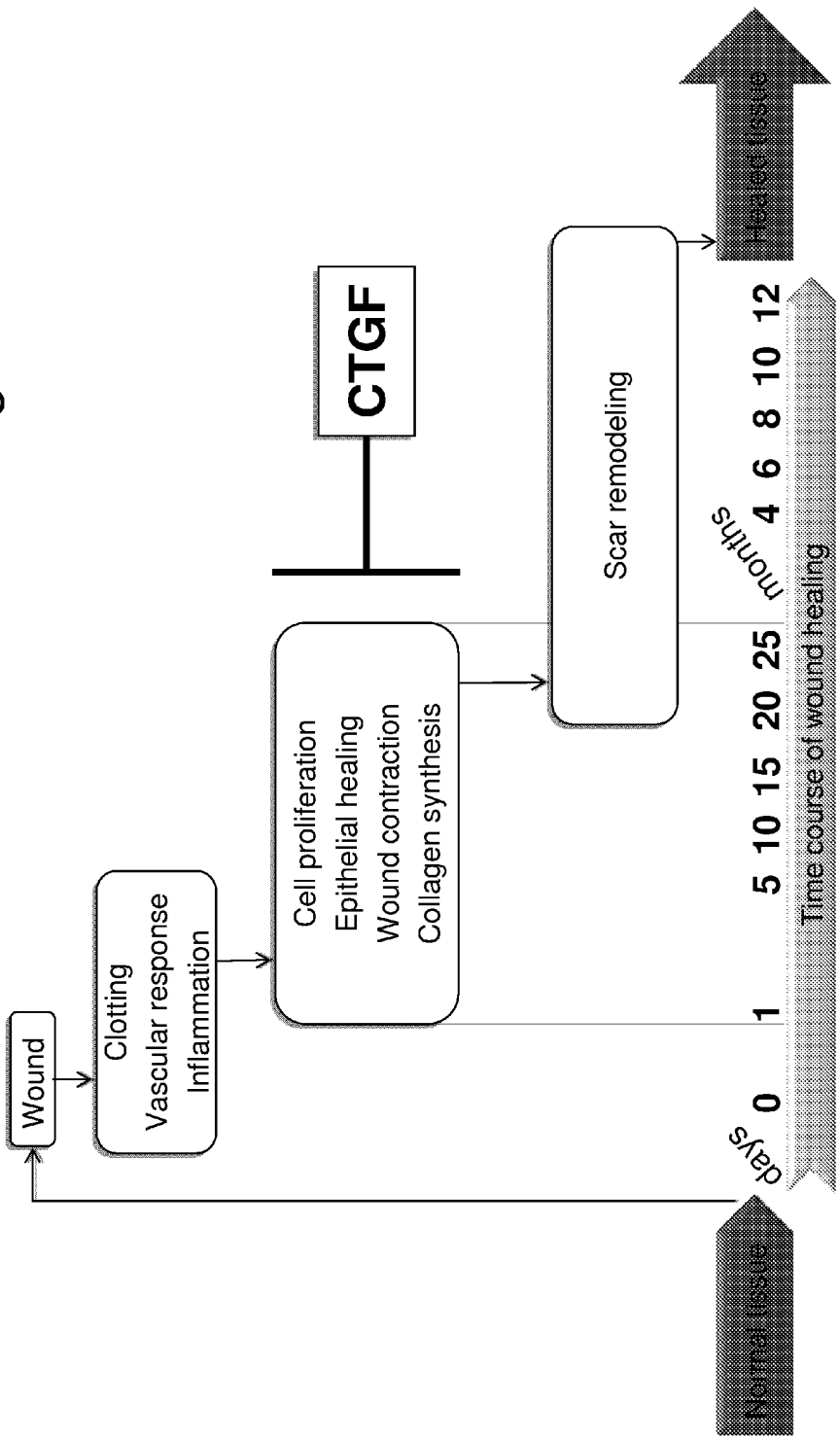
FIG. 31 depicts the phases of wound healing.
Figure 32:
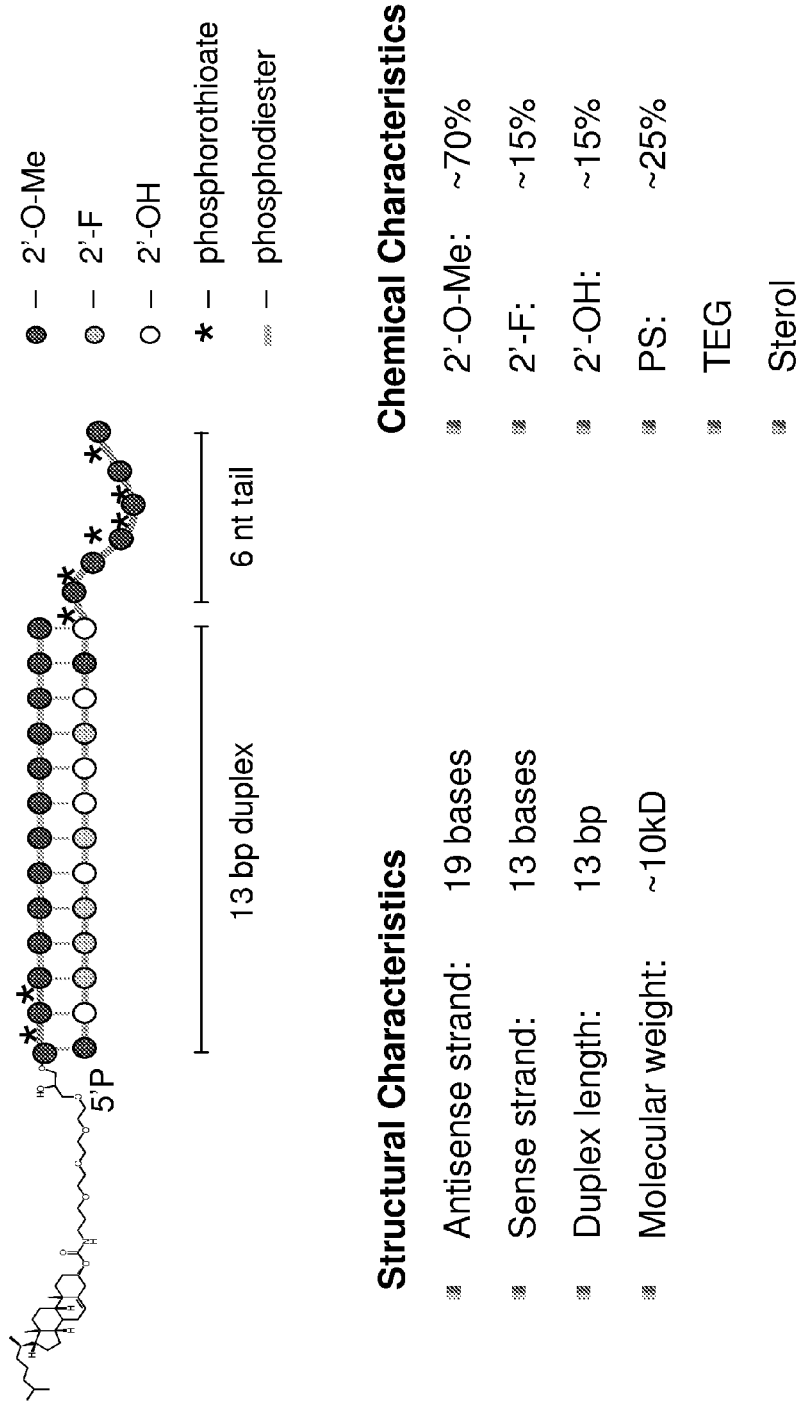
FIG. 32 depicts the chemical optimization of sd-rxRNA leads.

FIGS. 13-14 reveal that the original sd-rxrNA screen had a low hit rate. FIG. 15 reveals PTGS2 knockdown using sd-rxRNA against PTGS2. FIGS. 16-24 reveal that hTGFB1, TGFB, TGFB2 sd-rxRNAs are capable of mediating gene silencing. FIGS. 25-28 shows the identification of potent hSPP1 sd-rxRNAs.

Example 3

Linker Chemistry

Figure 36:
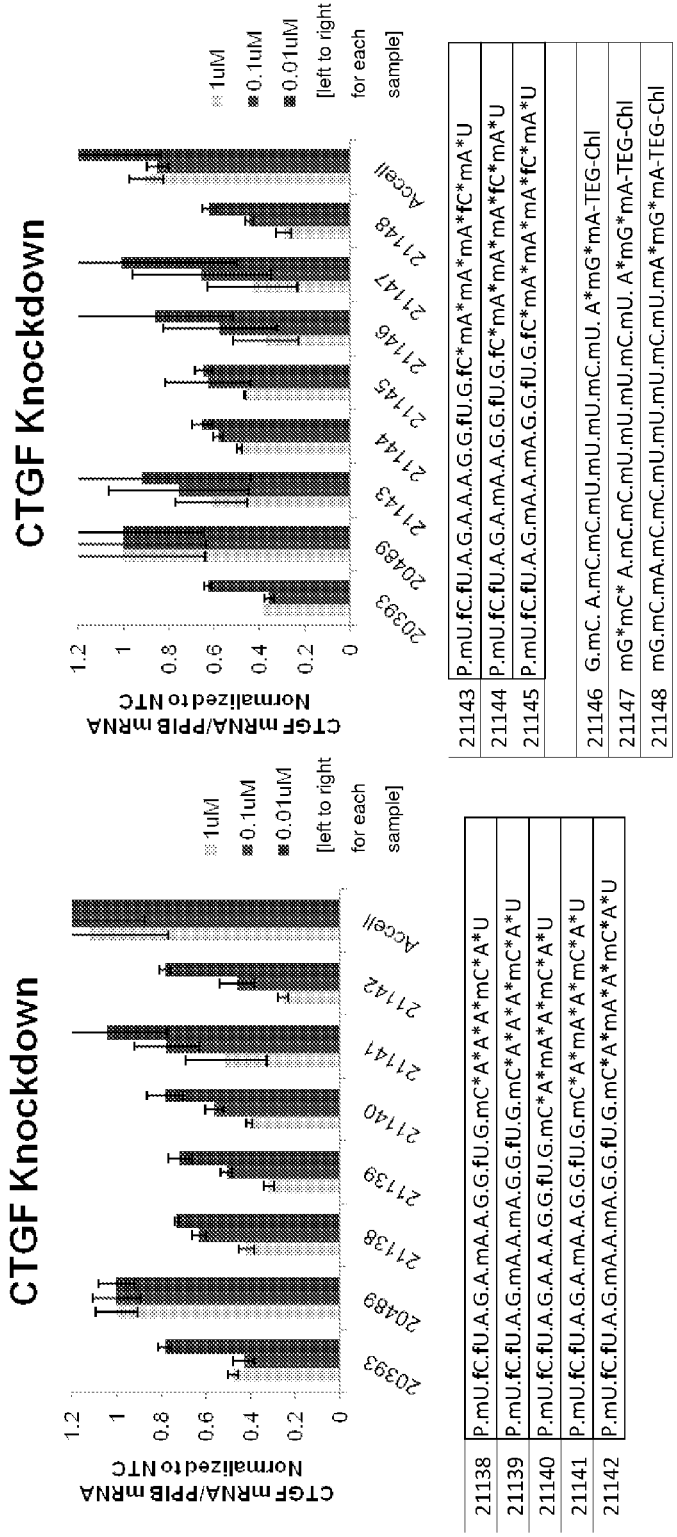
FIG. 36 demonstrates that chemically optimized CTGF L2 sd-rxRNAs are active.

FIG. 36 demonstrates that variation of linker chemistry does not influence silencing activity of sd-rxRNAs in vitro. Two different linker chemistries were evaluated, a hydroxyproline linker and ribo linker, on multiple sd-rxRNAs (targeting Map4k4 or PPIB) in passive uptake assays to determine linkers which favor self delivery. HeLa cells were transfected in the absence of a delivery vehicle (passive transfection) with sd-rxRNAs at 1 uM, 0.1 uM or 0.01 uM for 48 hrs. Use of either linker results in an efficacious delivery of sd-rxRNA.

The ribo linker used in Example 5 had the following structure:

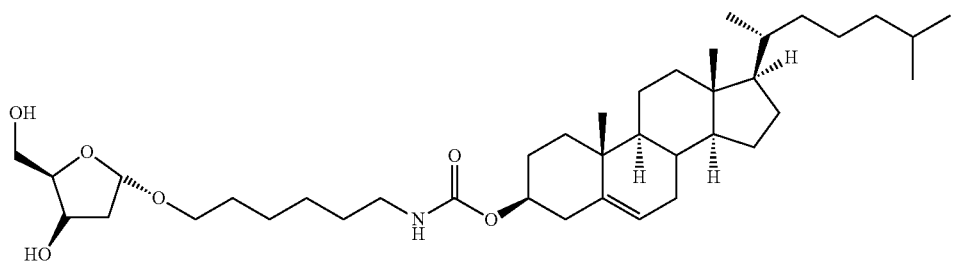

Example 4

Optimization of Target Sequences

Chemical optimization was performed for several lead sequences, including CTGF, PTGS2, TGFβ1, and TGFβ2. Multiples versions of sd-rxRNA leads were synthesized. The sense strand was further O-methyl modified, such as by introduction of O-methyl blocks on the ends, introduction of O-methyl phosphorothioate blocks at the ends or introduction of ful O-methyl modification with a phosphorothioate block on the 3' end.

The guide strand was modified to decrease the number of 2'F, substitute 2'F with O-methyl, vary the number of ribonucleotides, eliminate stretches of ribonucleotides, minimize the presence of ribonucleotides next to the phosphorothioate modifications, and if possible remove ribonucleotides from the single stranded region.

Various versions of compounds were synthesized and their efficacy was tested in vitro using passive uptake. The efficacy and toxicity of the optimized compounds was evaluated in vivo.

All compounds show in vivo efficacy. Initially, activity required high concentration and at high concentrations some compound demonstrated injection site reaction. However, data indicated that efficacy and toxicity in vivo could be dramatically improved by enhancement of stability and reduction of 2' F content. In some instances, toxicity, at least in part, was related to the presence of cholesterol containing short oligomer metabolites. This type of toxicity is expected to be reduced by stabilization. In general, chemical stabilization was well tolerated. Exact chemical optimization patterns differed for various compound. In some cases, complete stabilization resulted in a slightly negative impact on activity. For most target sites, at least two chemically optimized leads were identified: chemically optimized with in vitro efficacy retained or improved compared to an Early Lead and Fully Modified, where in vitro efficacy is slightly reduced.

In general, a fully O-methyl modified sense strand is acceptable. In some instances, it is preferable if less than all of the nucleotides in the sense strand are O-methyl modified. In some instances, the 3' end of the passenger strand contained a PS/O-METHYL block (2 O-methyl modifications and two 2 phosphorothioate modifications) to insure maximized stability next to the hydrophobic conjugate.

For all compounds, it was possible to identify functional heavily stabilized leads. In some instances, the number of ribonucleotides per compounds was reduced to 4-6. Multiples versions of sd-rxRNA leads were synthesized. The number of 2'F modified purines was limited where possible to improve manufacturability but some optimized compounds do contain some 2'F modified purines.

Optimized Compounds

A summary of CTGF lead compounds is shown in Table 24. PTGS leads are shown in Table 25. hTGFβ1 leads are shown in Table 26 and hTGFβ2 leads are shown in Table 27. Lead compounds were tested for in vitro efficacy with varying levels of methylation of the sense strand.

For CTGF Lead 1 (L1), the fully O-methyl modified sense strand was efficacious having a slight reduction in in vitro efficacy.

For CTGF L2, the fully O-methyl modified sense strand was efficacious, having a slight reduction in in vitro efficacy.

For CTGF L3, the fully O-methyl modified sense strand was partially efficacious, having a reduction in in vitro efficacy.

For CTGF L4, the fully O-methyl modified sense strand was partially efficacious, having a slight reduction in in vitro efficacy.

For PTGS2 L1 and L2, the fully O-methyl modified sense strand was not efficacious.

For TGFβ1 hL3, the fully O-methyl modified sense strand was efficacious.

For TGFβ2, the fully O-methyl modified sense strand was efficacious.

In Vivo Efficacy of Lead Compounds

Figure 33:
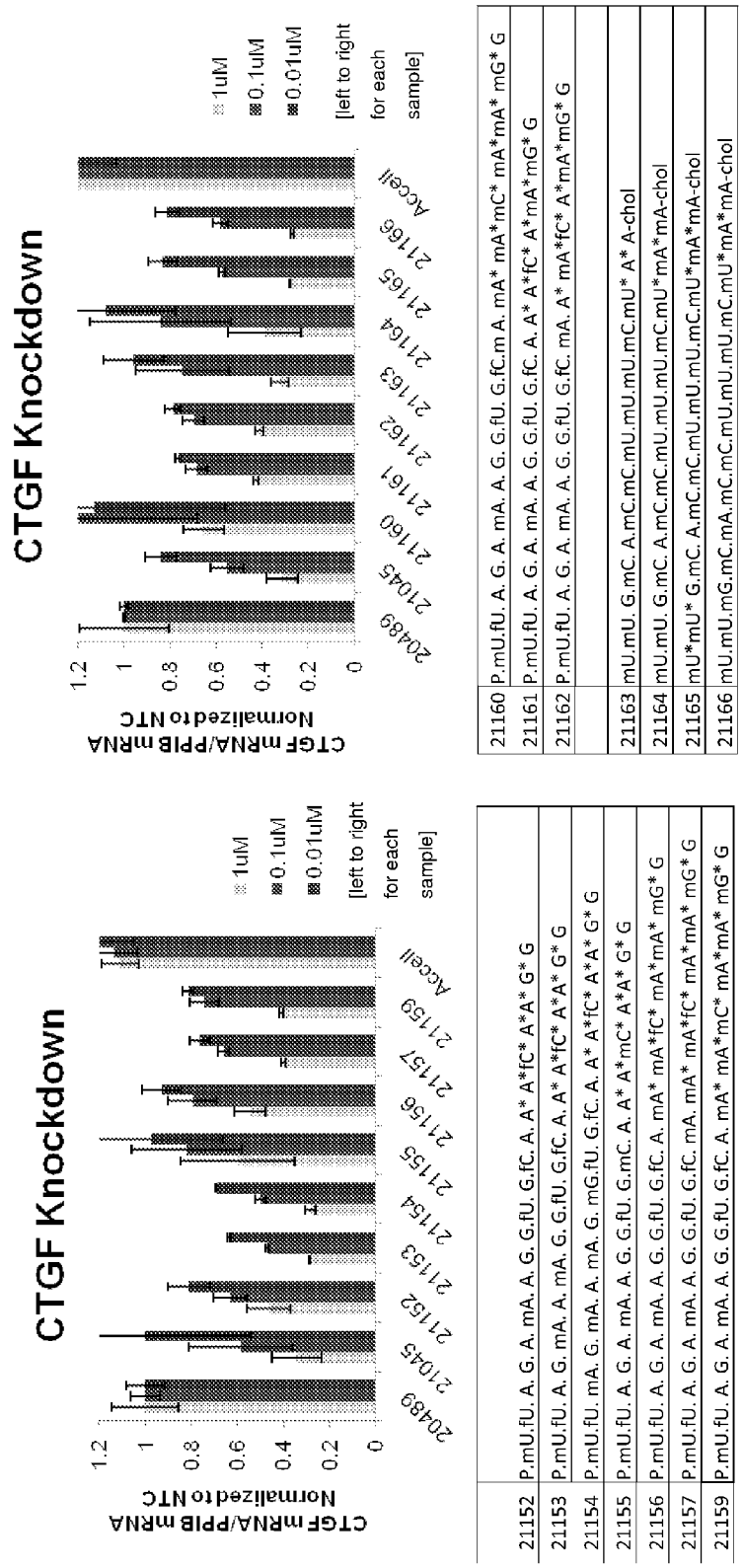
FIG. 33 demonstrates that chemically optimized CTGF L1 sd-rxRNAs are active.
Figure 34:
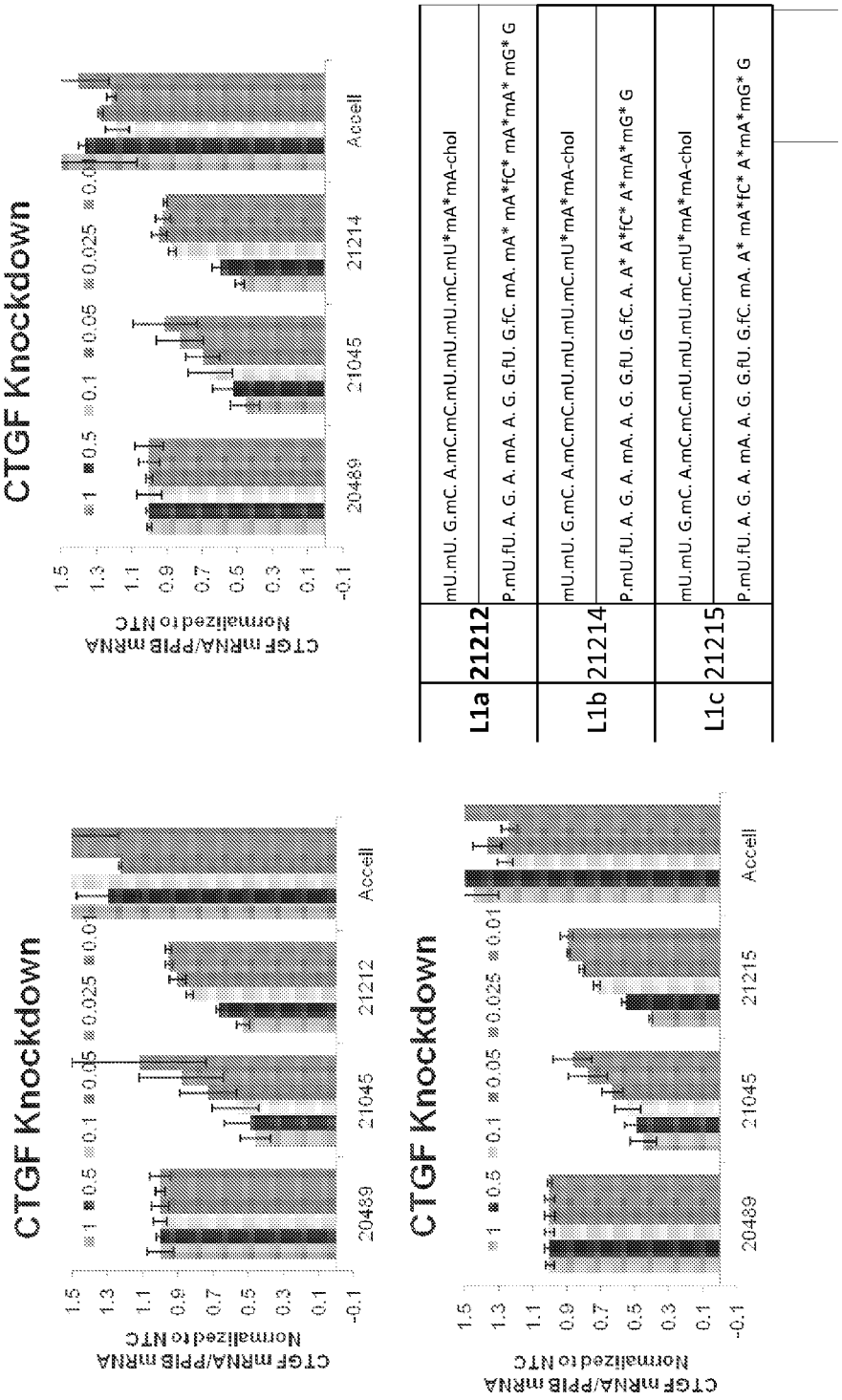
FIG. 34 demonstrates in vitro efficacy of chemically optimized CTGF L1 sd-rxRNAs.
Figure 35:
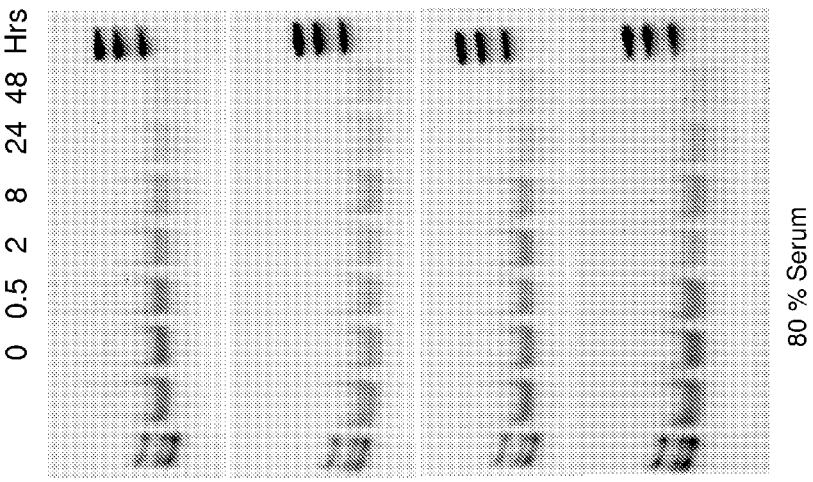
FIG. 35 demonstrates in vitro stability of chemically optimized CTGF L1 sd-rxRNAs.
Figure 37:
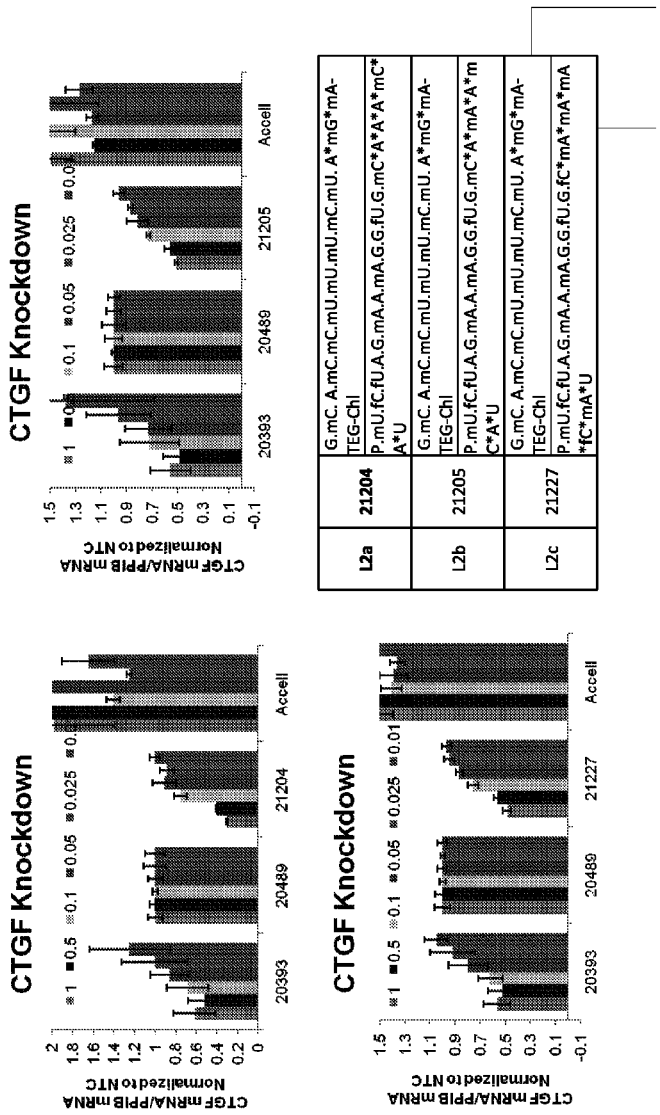
FIG. 37 demonstrates in vitro efficacy of chemically optimized CTGF L2 sd-rxRNAs.
Figure 38:
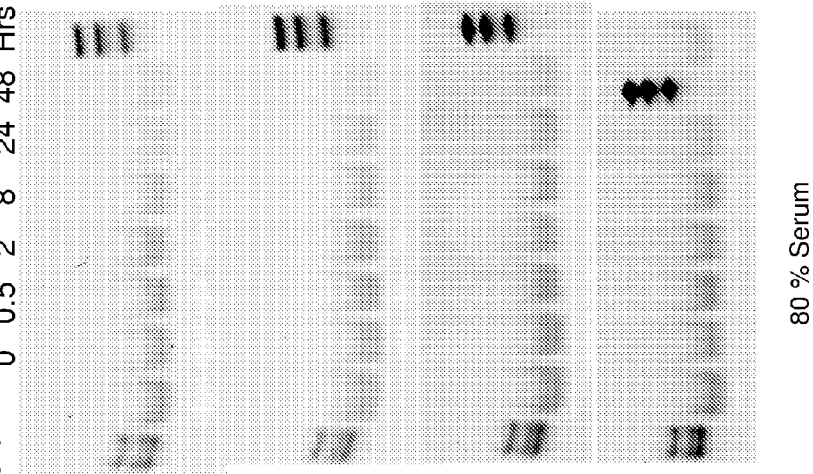
FIG. 38 demonstrates in vitro stability of chemically optimized CTGF L2 sd-rxRNAs.
Figure 40:
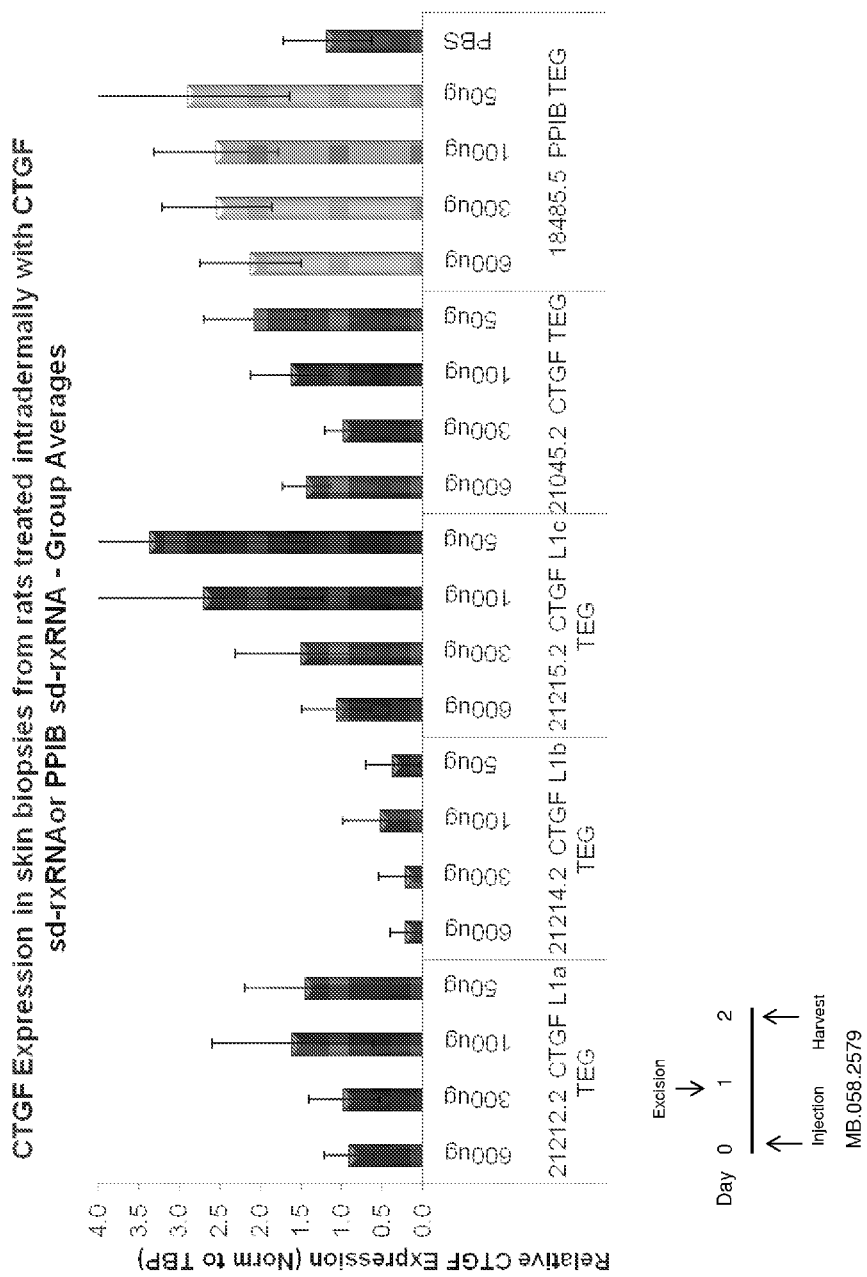
FIG. 40 demonstrates that treatment with CTGF L1B target sequence resulted in mRNA silencing.
Figure 41:
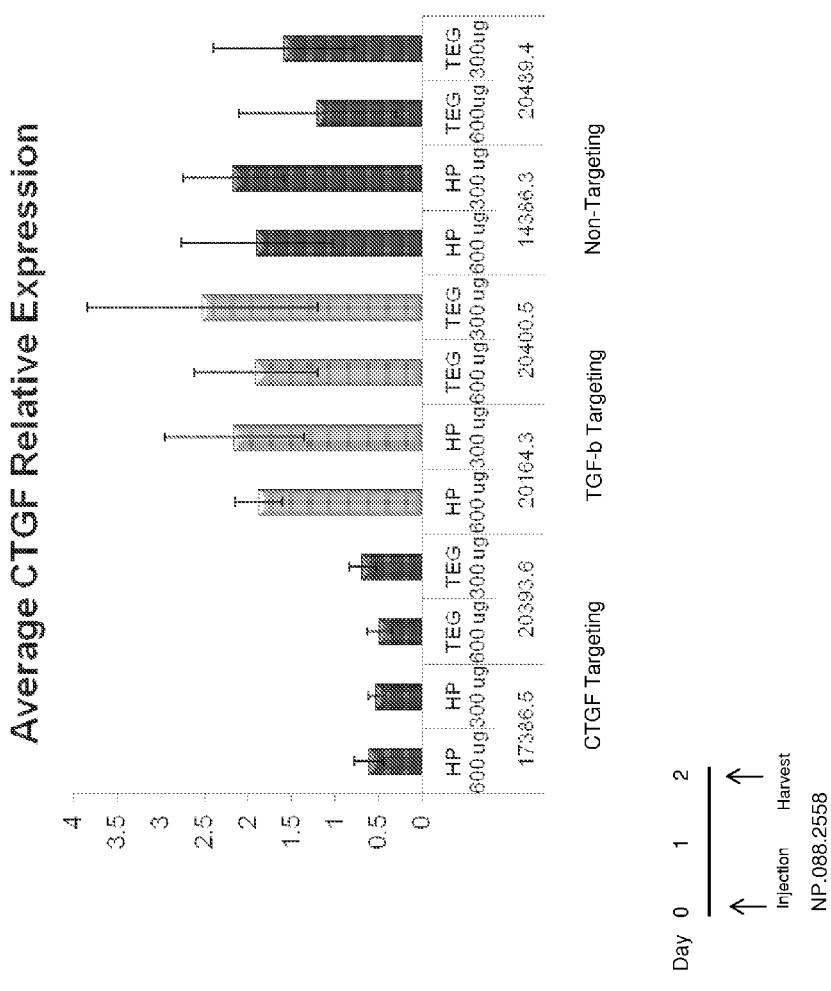
FIG. 41 demonstrates that treatment with CTGF L2 target sequence resulted in mRNA silencing.

The activity of lead compounds was tested in vivo both in cell culture and in animal models. FIGS. 33 and 34 demonstrate the activity of optimized CTGF L1 compounds. FIG. 35 demonstrates the in vitro stability of the CTGF L1 compounds. FIGS. 36 and 37 demonstrate the activity of optimized CTGF L2 compounds. FIG. 38 demonstrates the in vitro stability of the CTGF L2 compounds. FIG. 39 provides a summary of the in vivo activity of CTGF lead compounds. FIG. 40 demonstrates the efficacy of CTGF L1 compounds in skin biopsies from rats. FIG. 41 shows the efficacy of CTGF L2 compounds in achieving gene silencing.

Figure 42:
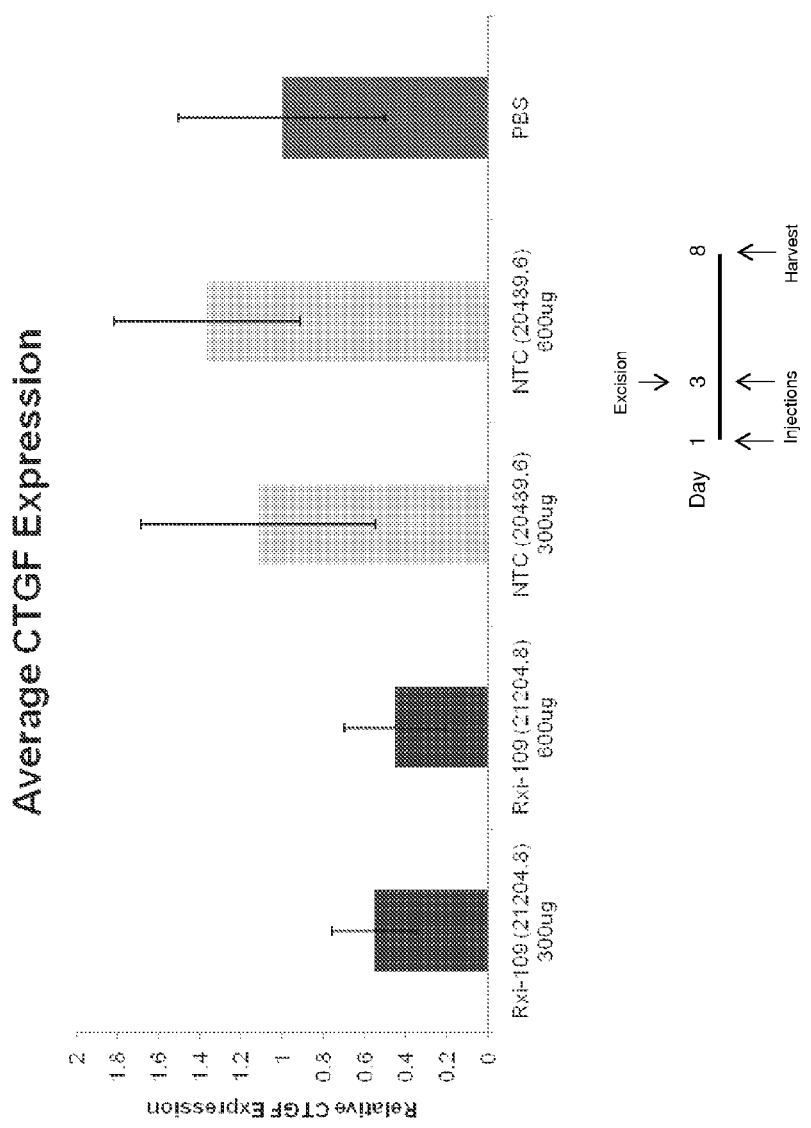
FIG. 42 demonstrates CTGF silencing after two intradermal injections of RXi-109.
Figure 43:
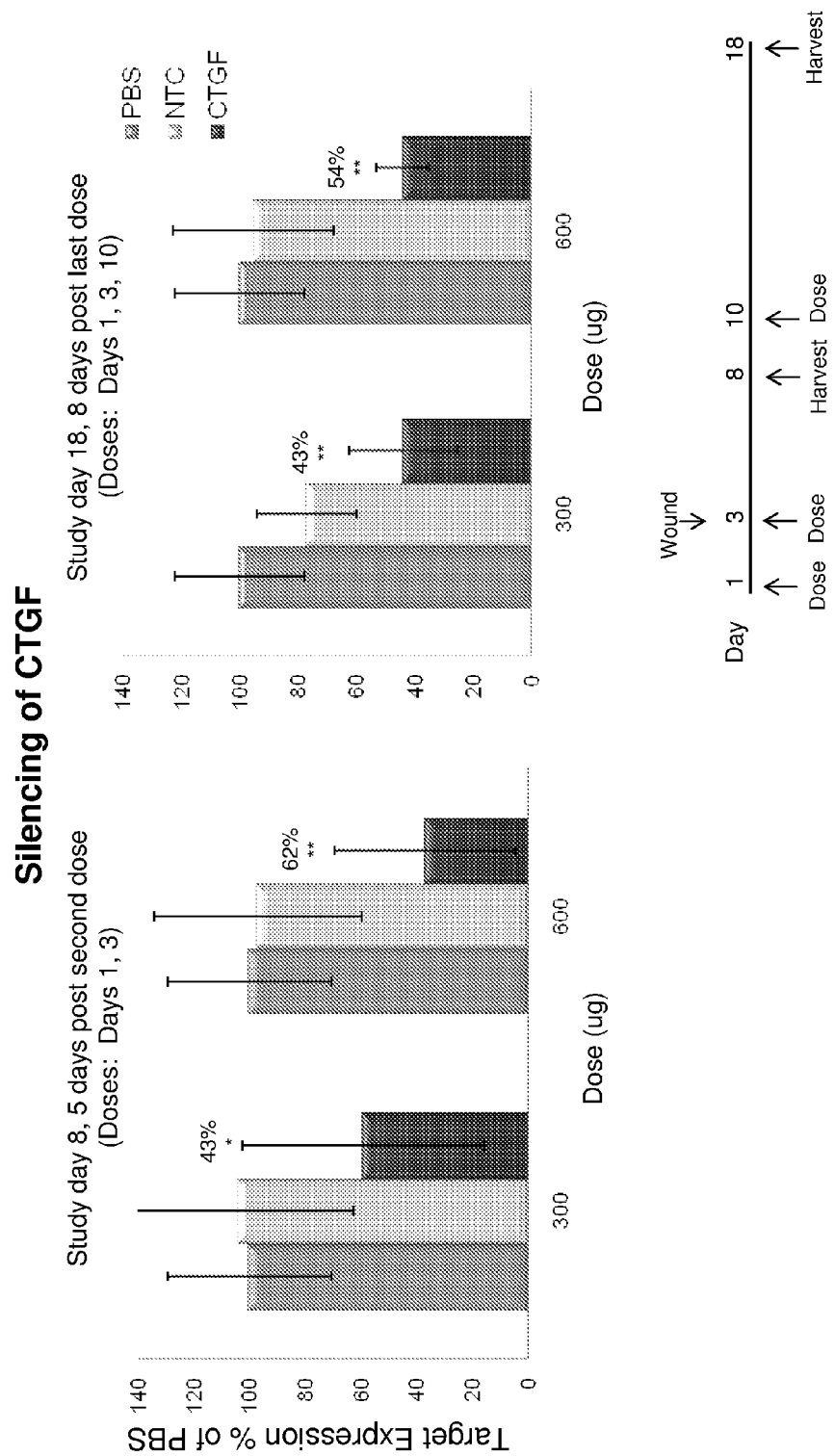
FIG. 43 demonstrates the duration of CTGF silencing in skin after intradermal injection of the sd-rxRNA in SD rats. Eight millimeter skin biopsies were harvested, and mRNA levels were quantified by QPCR and normalized to a housekeeping gene. Shown is percent (%) silencing vs. Non Targeting Control (NTC); PBS at each time point is one experimental group; * p≤0.04; ** p≤0.002.

FIG. 42 demonstrates CTGF silencing following intradermal injection of RXi-109. FIG. 43 demonstrates the duration of CTGF silencing in skin after intradermal injection of the sd-rxRNA in SD rats. Eight millimeter skin biopsies were harvested, and mRNA levels were quantified by QPCR and normalized to a housekeeping gene. Shown is percent (%) silencing vs. Non Targeting Control (NTC); PBS at each time point is one experimental group; * p≤0.04; ** p≤0.002.

Figure 44:
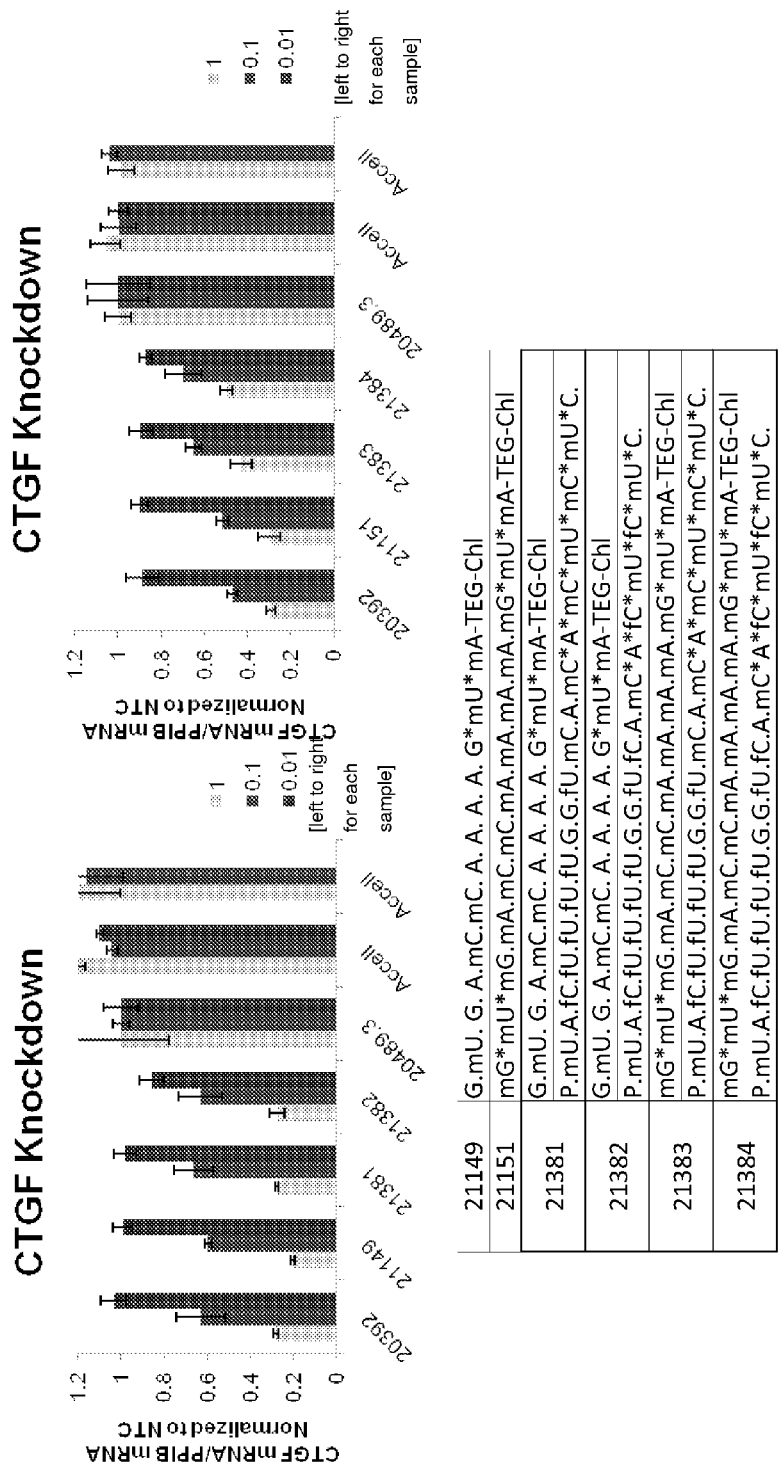
FIG. 44 demonstrates that chemically optimized CTGF L3 sd-rxRNAs are active.
Figure 46:
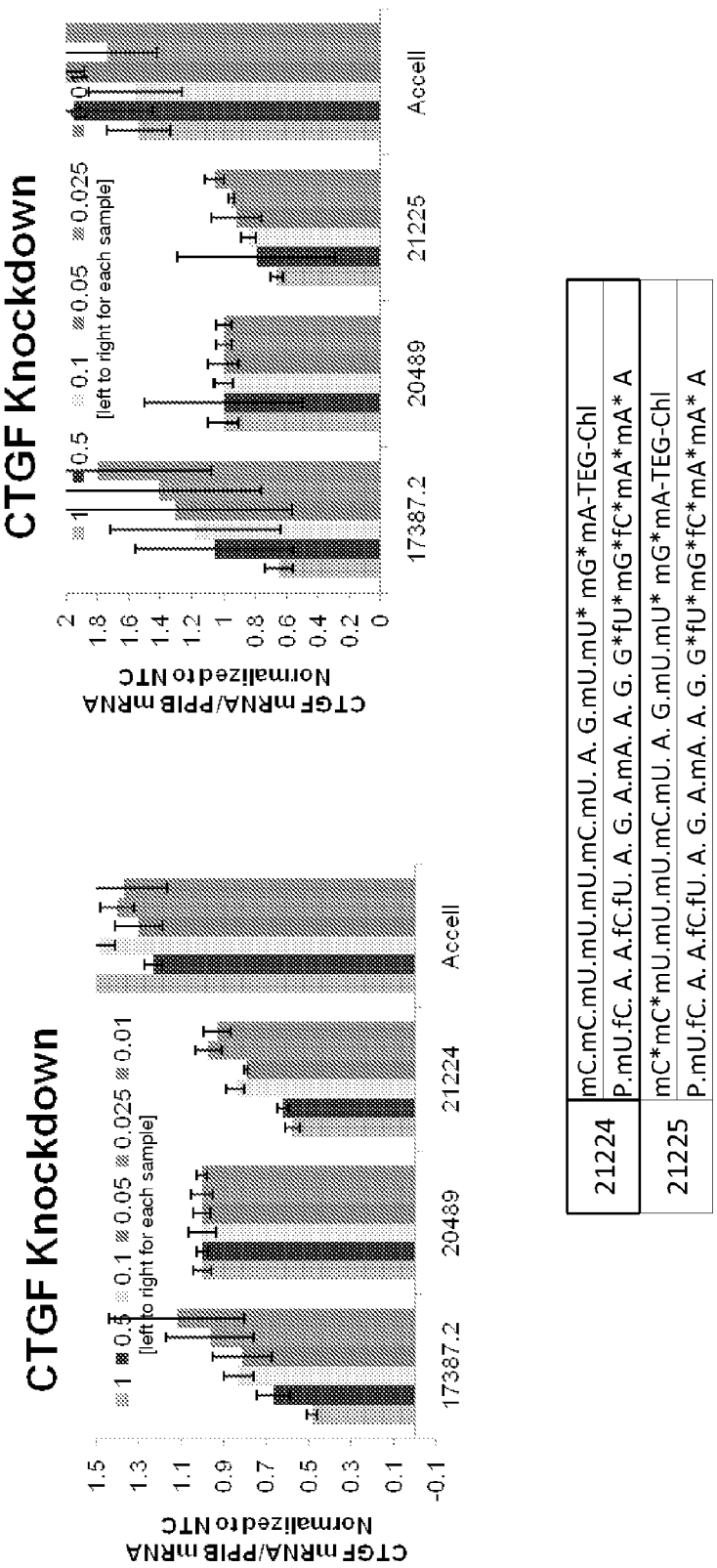
FIG. 46 demonstrates that chemically optimized CTGF L4 sd-rxRNAs are active.
Figure 47:
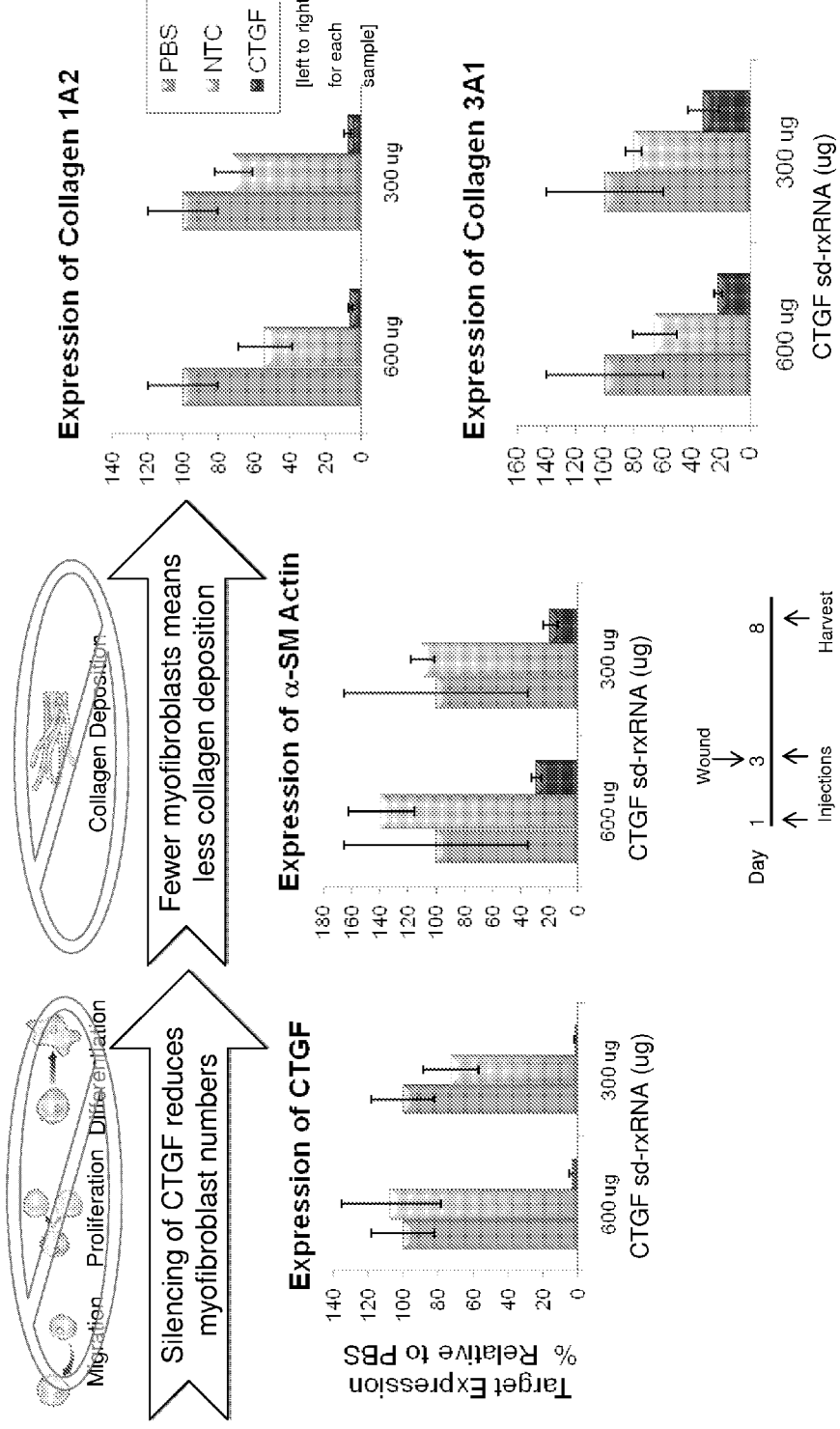
FIG. 47 demonstrates changes in mRNA expression levels of CTGF, α-SM actin, collagen 1A2, and collagen 3A1 after intradermal injection of CTFG sd-rxRNA in SD rats. mRNA levels were quantified by qPCR.
Figure 48:
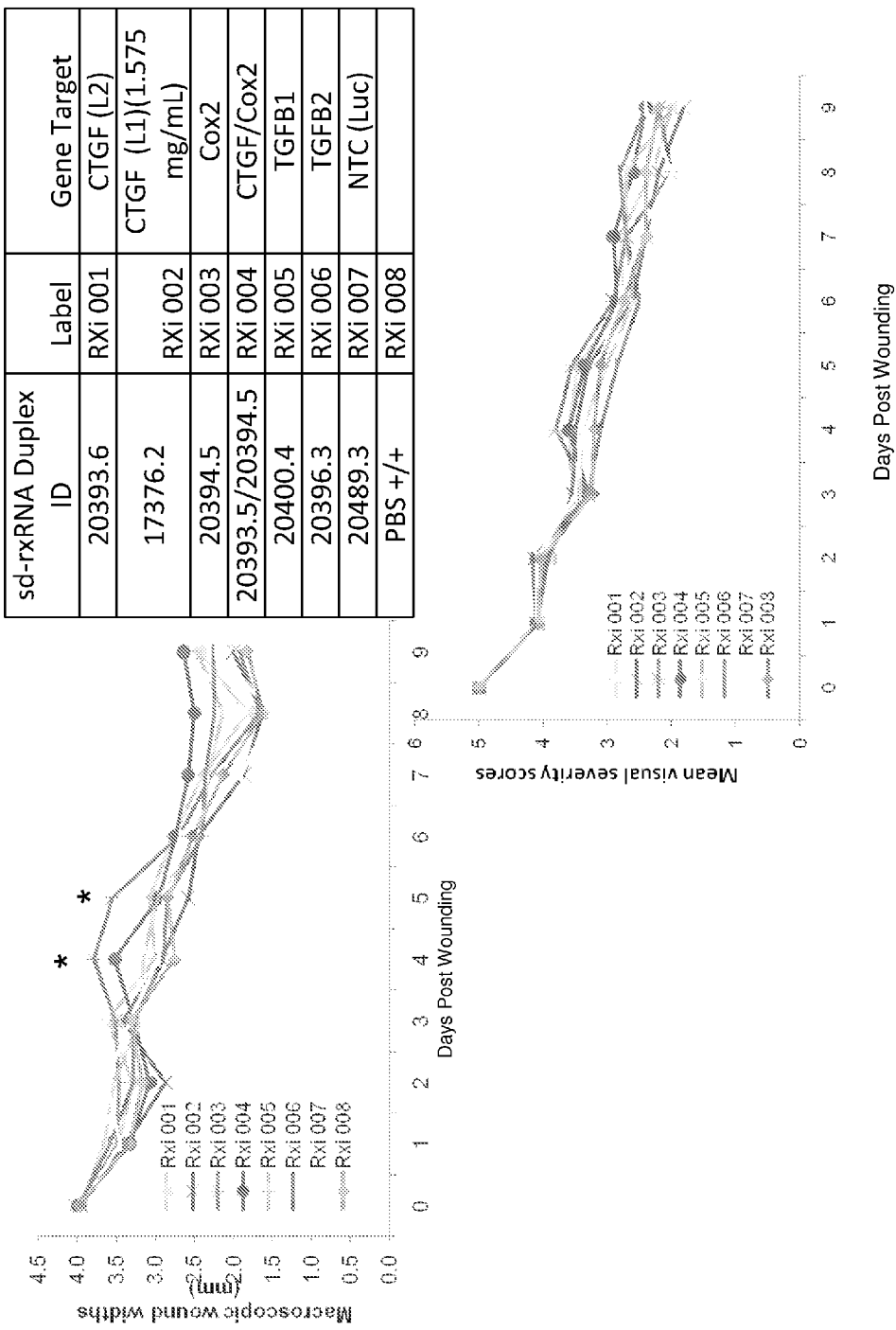
FIG. 48 demonstrates that there is no apparent delay in wound healing with treatment of CTGF-targeting sd-rxRNA. Some changes was observed with treatment of a combination of CTGF- and COX2-targeting sd-rxRNAs.

FIGS. 44-46 show that CTGF L3 and L4 compounds are also active. FIG. 47 demonstrates changes in mRNA expression levels of CTGF, α-SM actin, collagen 1A2, and collagen 3A1 after intradermal injection of CTFG sd-rxRNA in SD rats. mRNA levels were quantified by qPCR. Substantial reduction in CTGF expression is observed.

Figure 49:
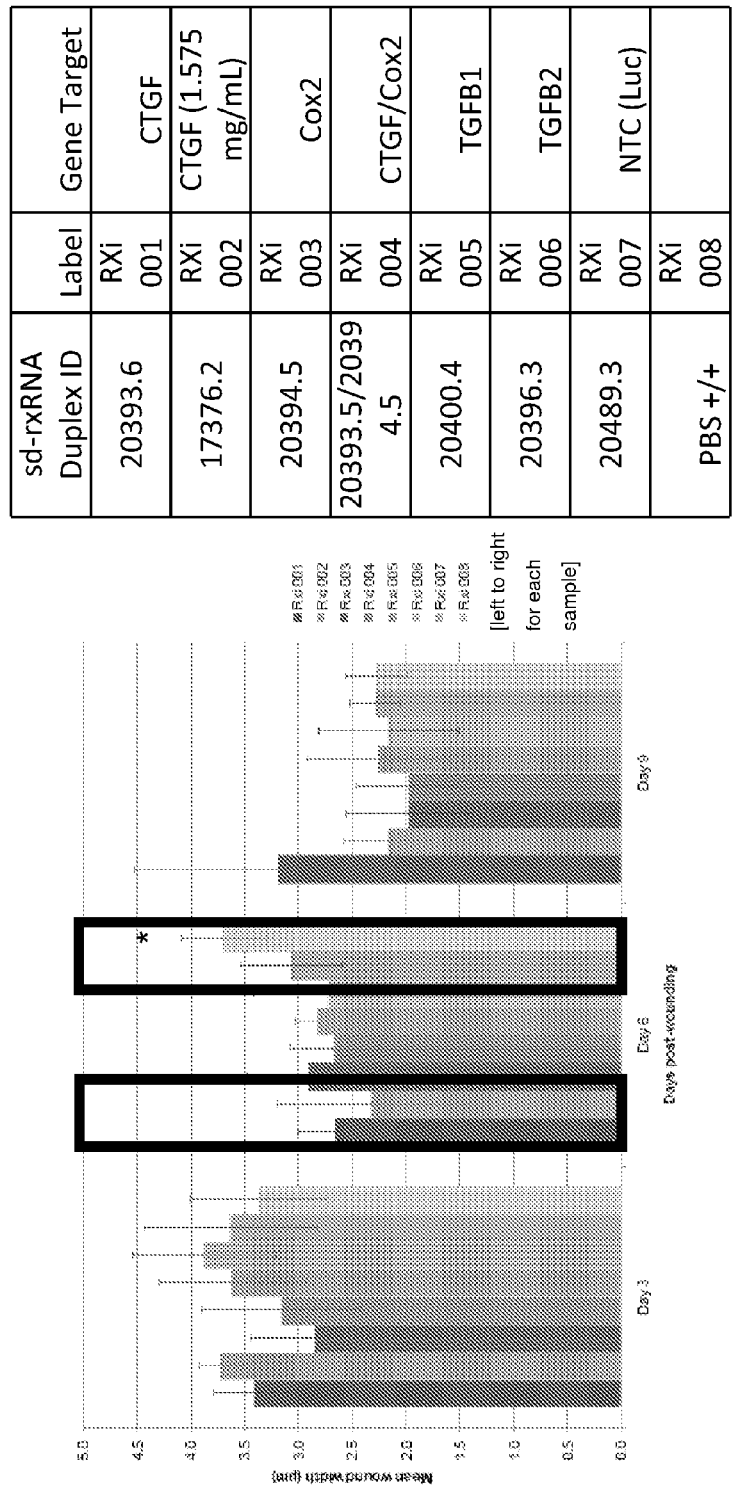
FIG. 49 demonstrates that administration of sd-rxRNAs decreases wound width over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

FIG. 49 demonstrates that administration of sd-rxRNAs decreases wound width over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

Figure 50:
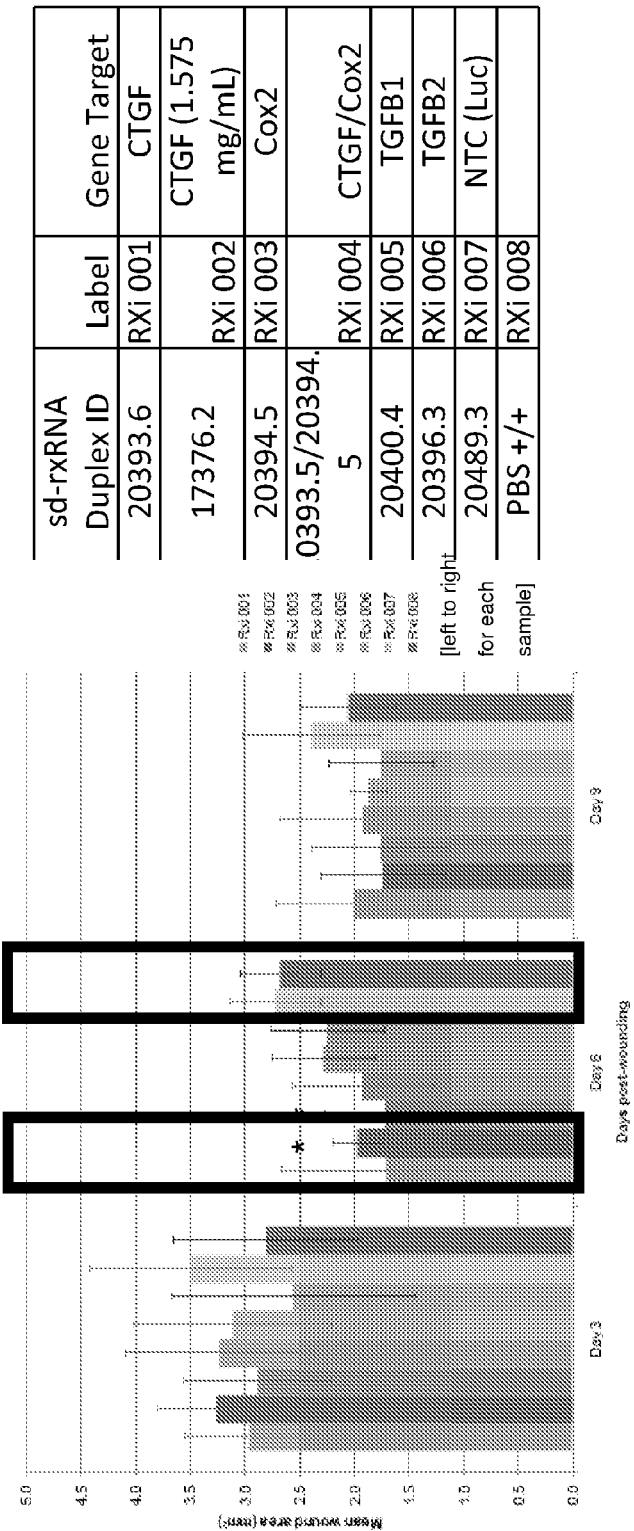
FIG. 50 demonstrates that administration of sd-rxRNAs decreases wound area over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

FIG. 50 demonstrates that administration of sd-rxRNAs decreases wound area over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

Figure 51:
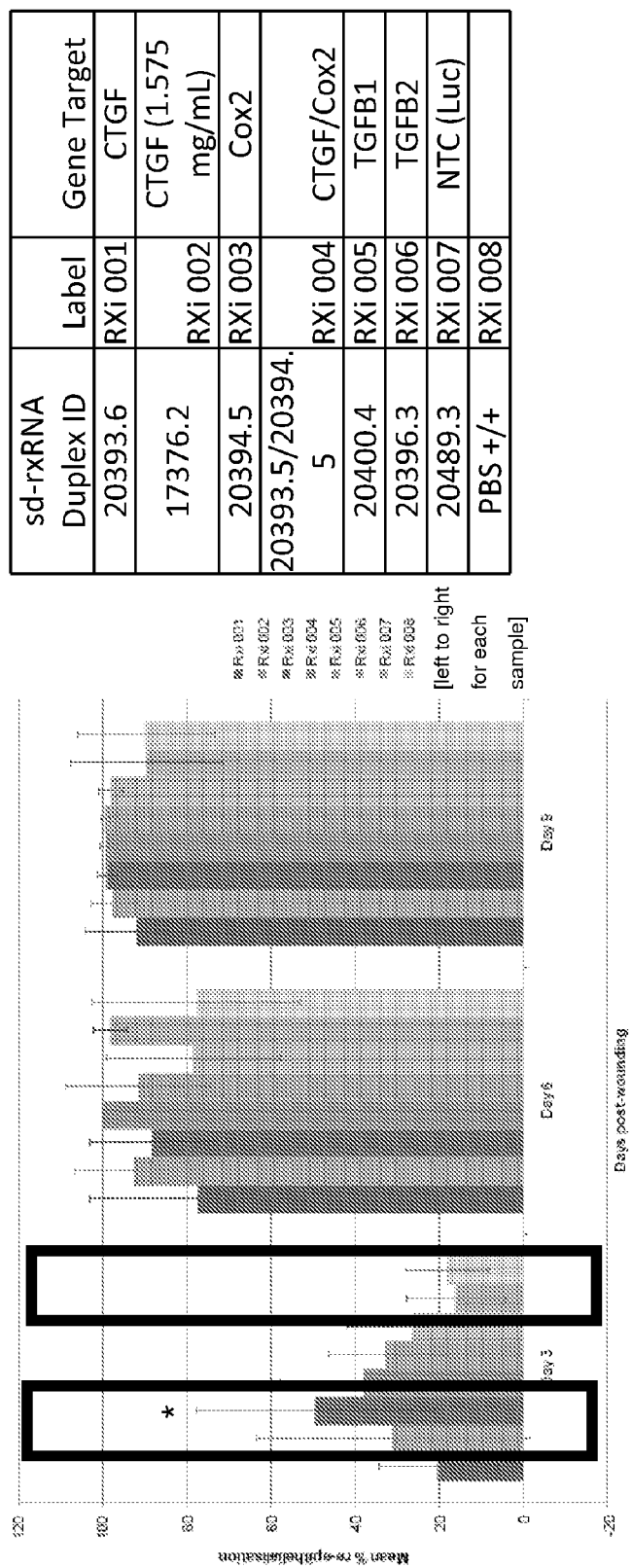
FIG. 51 demonstrates that administration of sd-rxRNAs increase the percentage of wound re-epithelialization over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

FIG. 51 demonstrates that administration of sd-rxRNAs increase the percentage of wound re-epithelialization over the course of at least 9 days. The graph shows microscopic measurements of wound width in rats on days 3, 6, and 9 post-wounding. Each group represents 5 rats. Two non-serial sections from each wound were measured and the average width of the two was calculated per wound. *p<0.05 vs. PBS an NTC.

Figure 52:
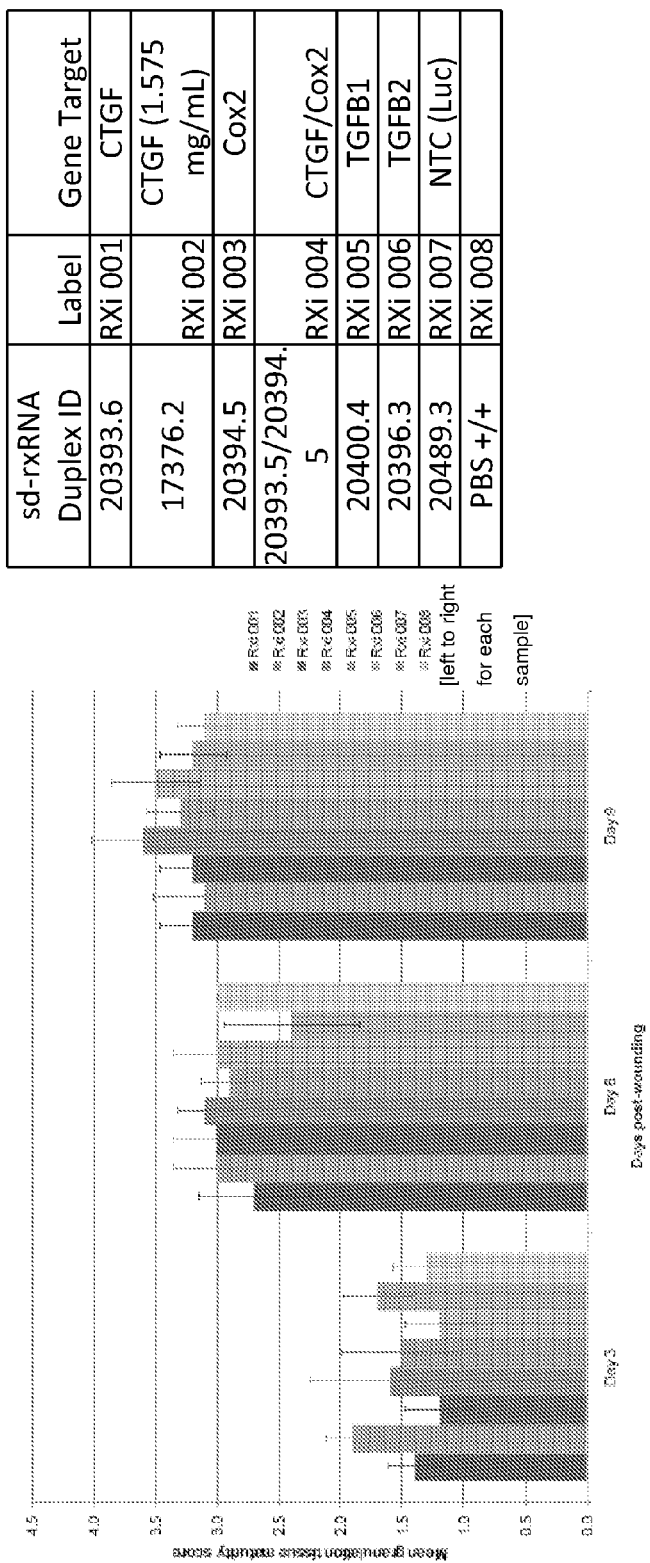
FIG. 52 demonstrates that administration of sd-rxRNAs increases the average granulation tissue maturity scores over the course of at least 9 days. The graph shows microscopic measurements of wound width in rats on days 3, 6, and 9 post-wounding (5=mature, 1=immature). Each group represents 5 rats.
Figure 53:
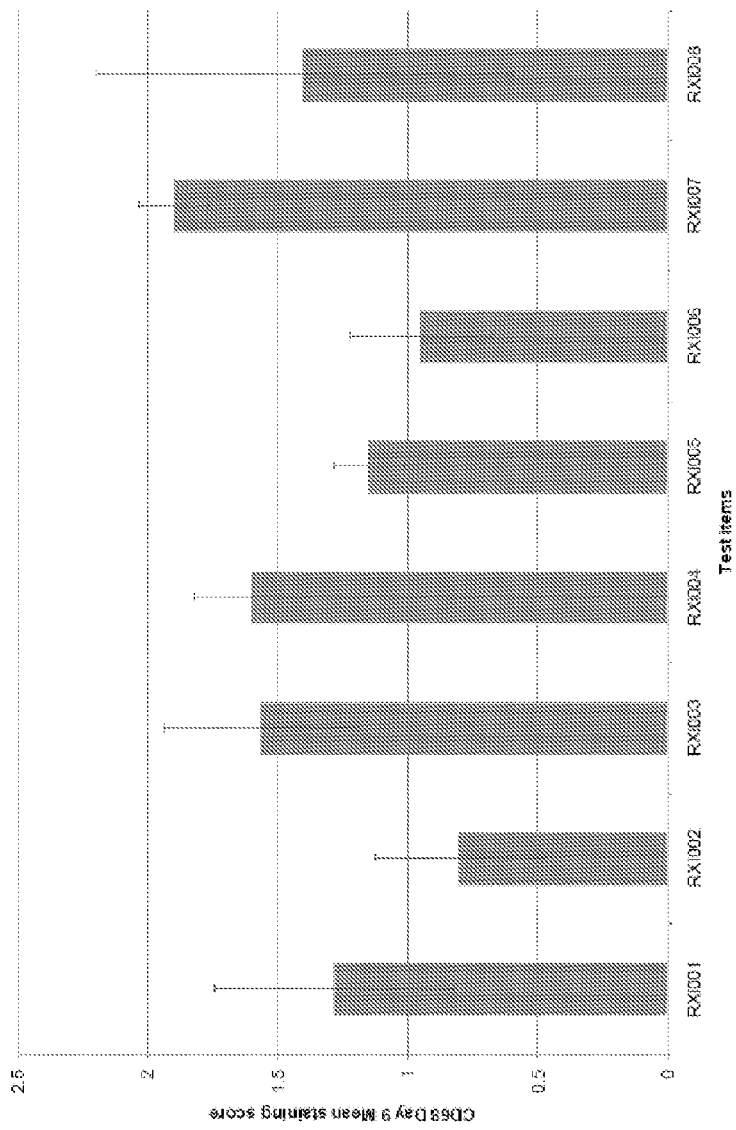
FIG. 53 demonstrates CD68 labeling in day 9 wounds (0=no labeling, 3=substantial labeling). Each group represents 5 rats.

FIG. 52 demonstrates that administration of sd-rxRNAs increases the average granulation tissue maturity scores over the course of at least 9 days. The graph shows microscopic measurements of wound width in rats on days 3, 6, and 9 post-wounding (5=mature, 1=immature). Each group represents 5 rats. FIG. 53 demonstrates CD68 labeling in day 9 wounds (0=no labeling, 3=substantial labeling). Each group represents 5 rats.

Figure 54:
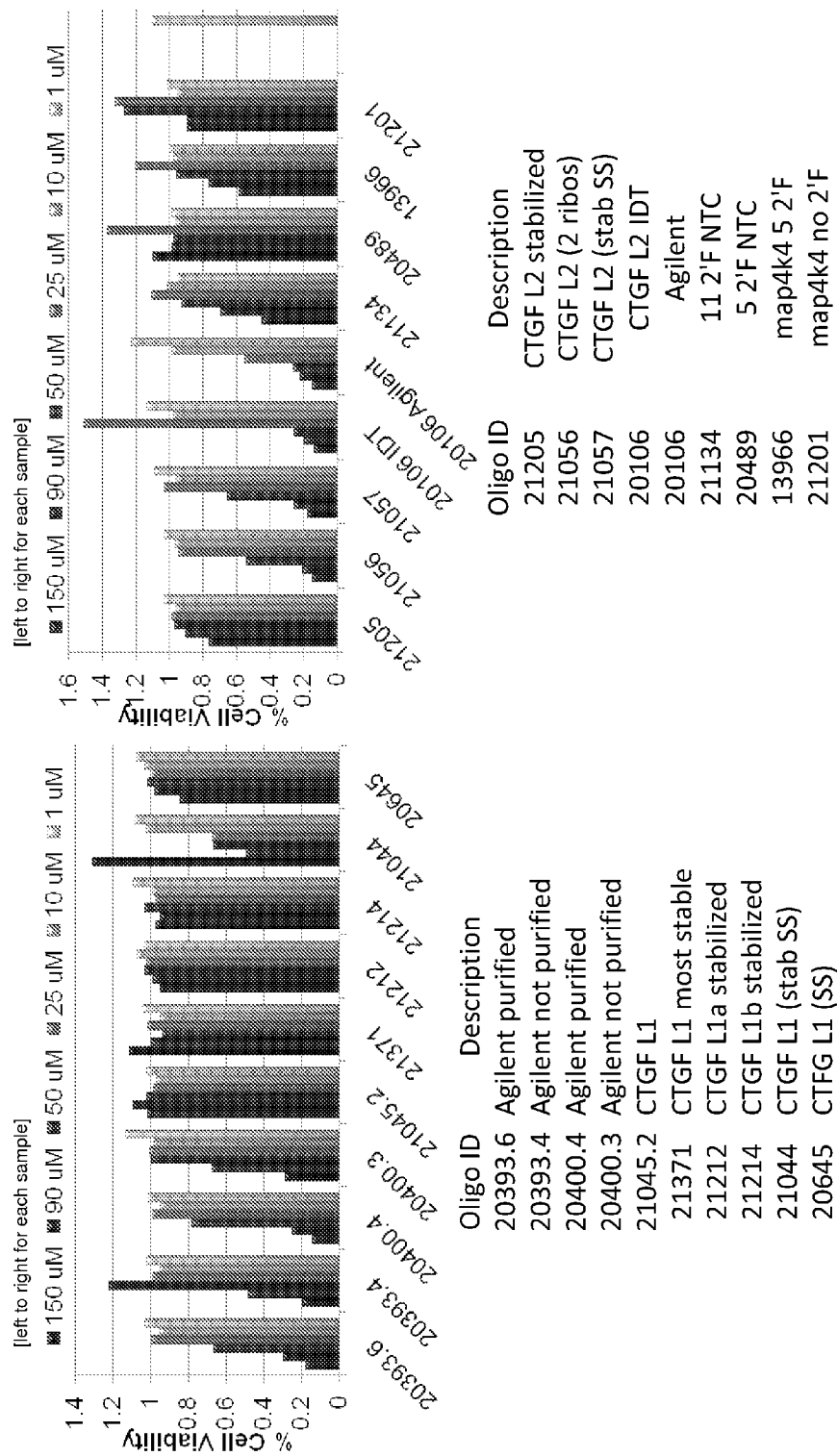
FIG. 54 demonstrates that CTGF leads have different toxicity levels in vitro.
Figure 55:
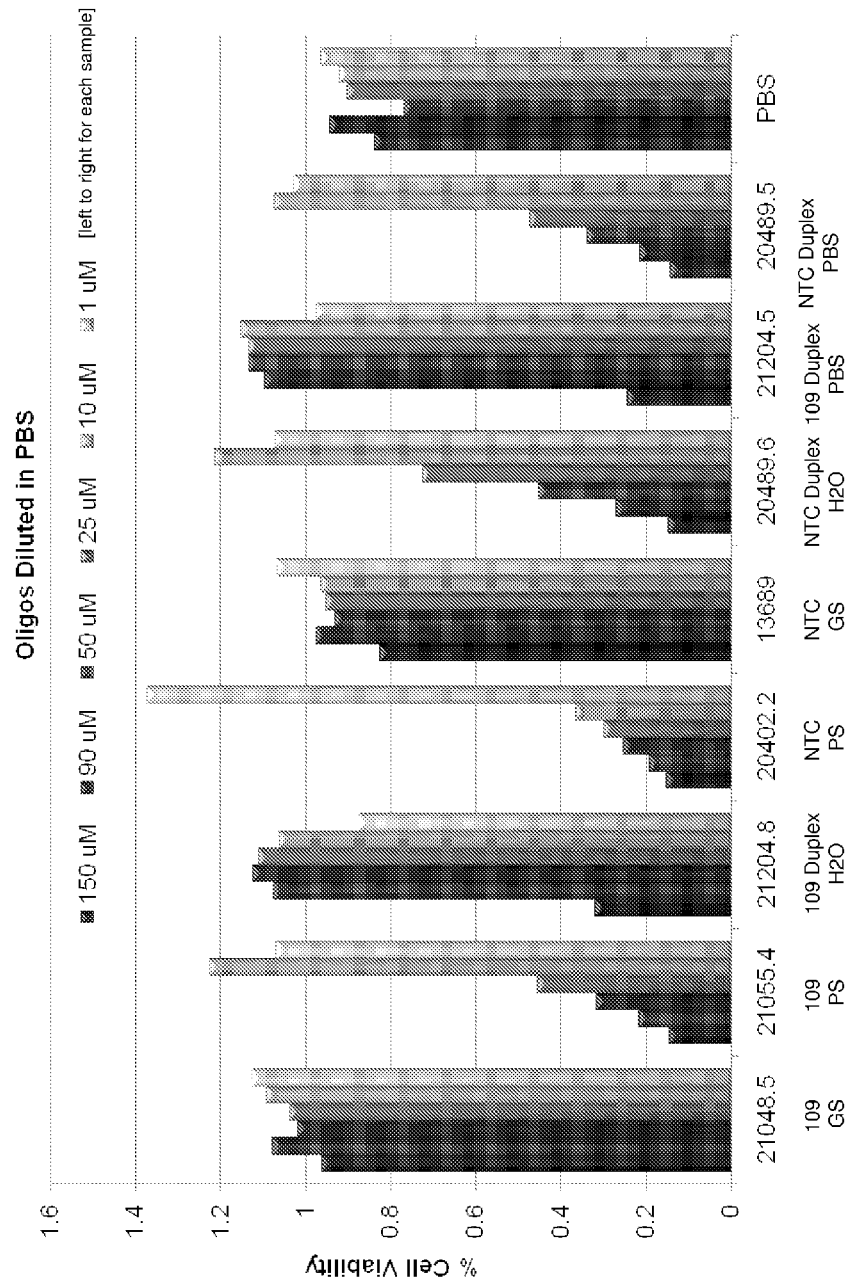
FIG. 55 shows percentage (%) of cell viability after RXI 109 dose escalation (oligos formulated in PBS).

FIG. 54 demonstrates that CTGF leads have different toxicity levels in vitro. FIG. 55 shows percentage (%) of cell viability after RXi-109 dose escalation (oligos formulated in PBS).

Figure 56:
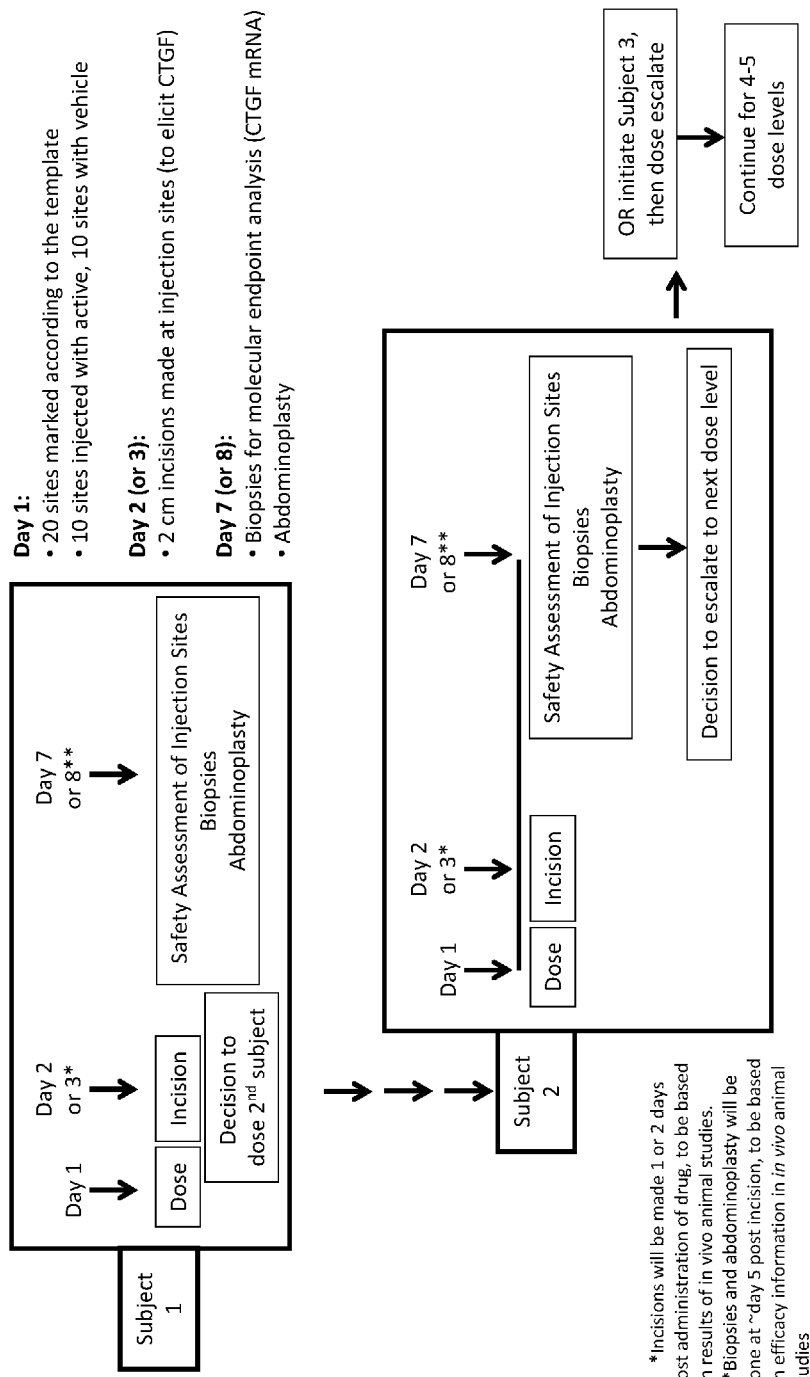
FIG. 56 is a schematic of Phases 1 and 2 clinical trial design.

FIG. 56 is a schematic of a non-limiting example of a Phase 1 and 2 clinical trial design for lead compounds. This schematic represents a divided dose, single day ascending dose clinical trial.

Figure 57:
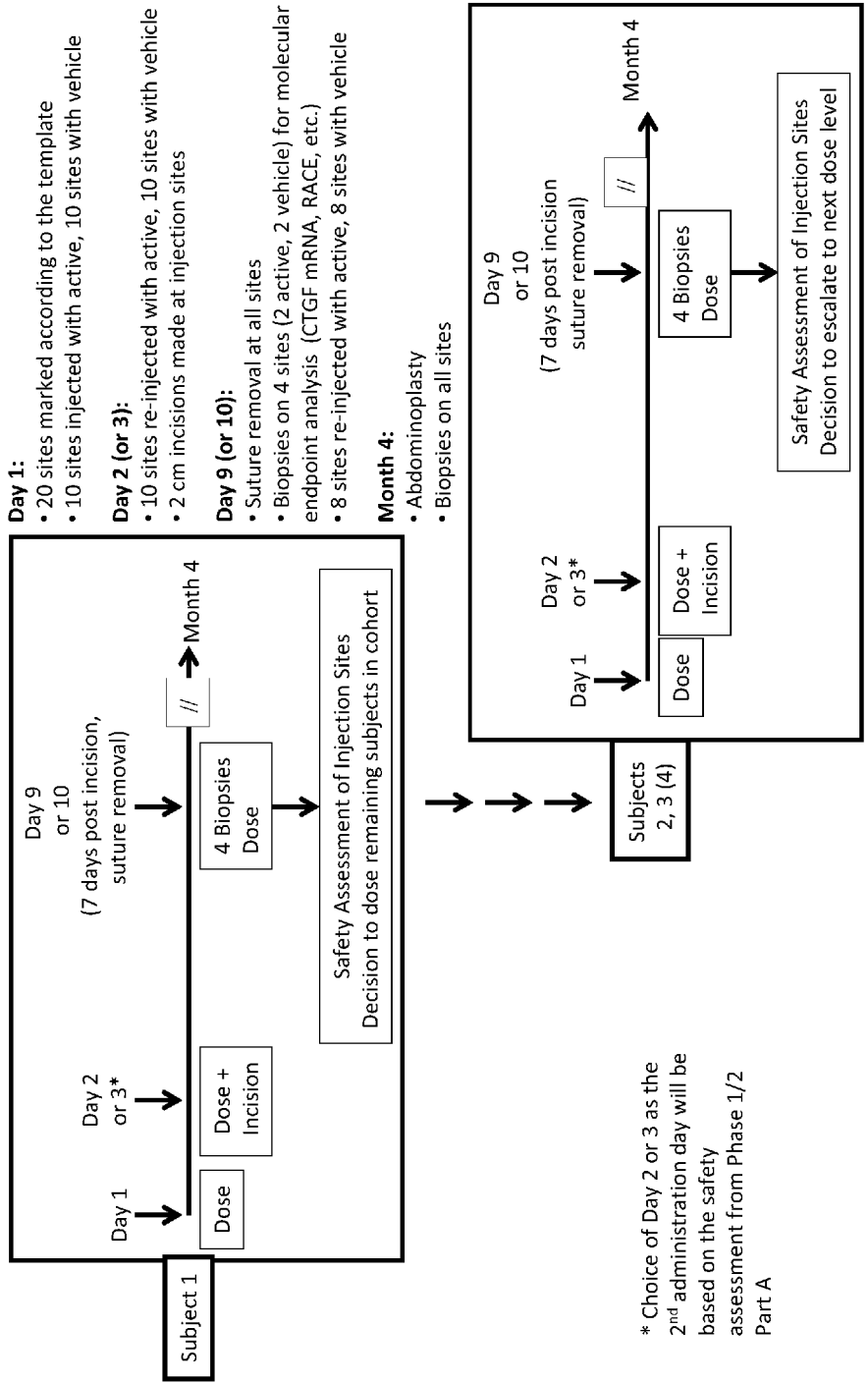
FIG. 57 is a schematic of Phases 1 and 2 clinical trial design.

FIG. 57 is a schematic of a non-limiting example of a Phase 1 and 2 clinical trial design. This schematic represents a divided dose, multi-day ascending dose clinical trial.

Figure 59:
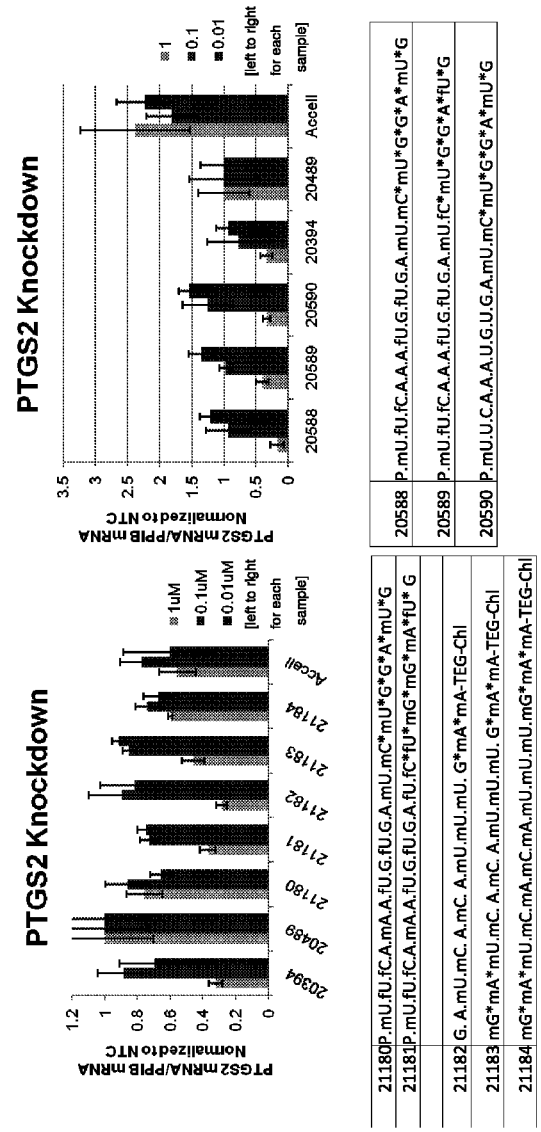
FIG. 59 demonstrates that chemically optimized PTGS2 L1 sd-rxRNAs are active.
Figure 60:
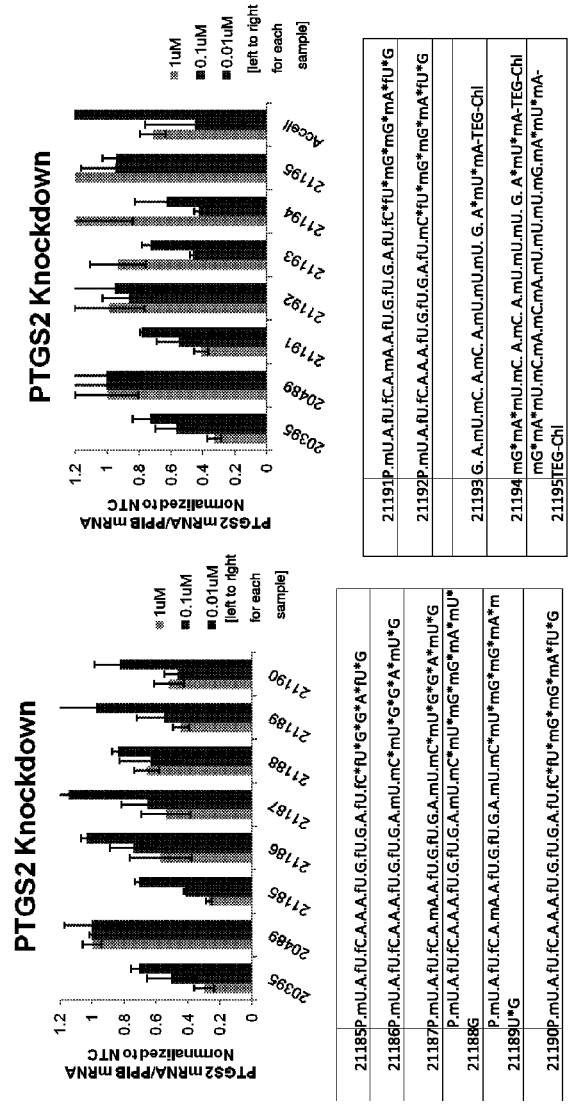
FIG. 60 demonstrates that chemically optimized PTGS2 L2 sd-rxRNAs are active.
Figure 62:
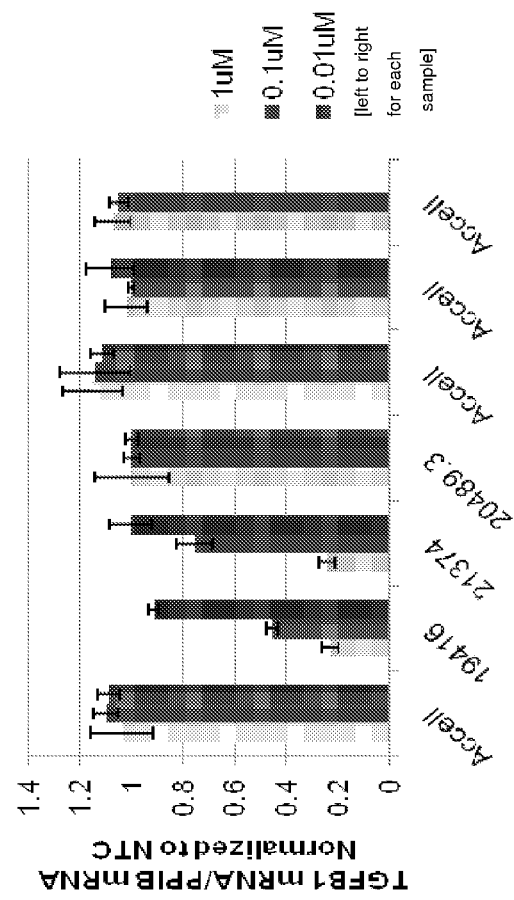
FIG. 62 demonstrates that chemically optimized hTGFB1 L1 sd-rxRNAs are active.
Figure 63:
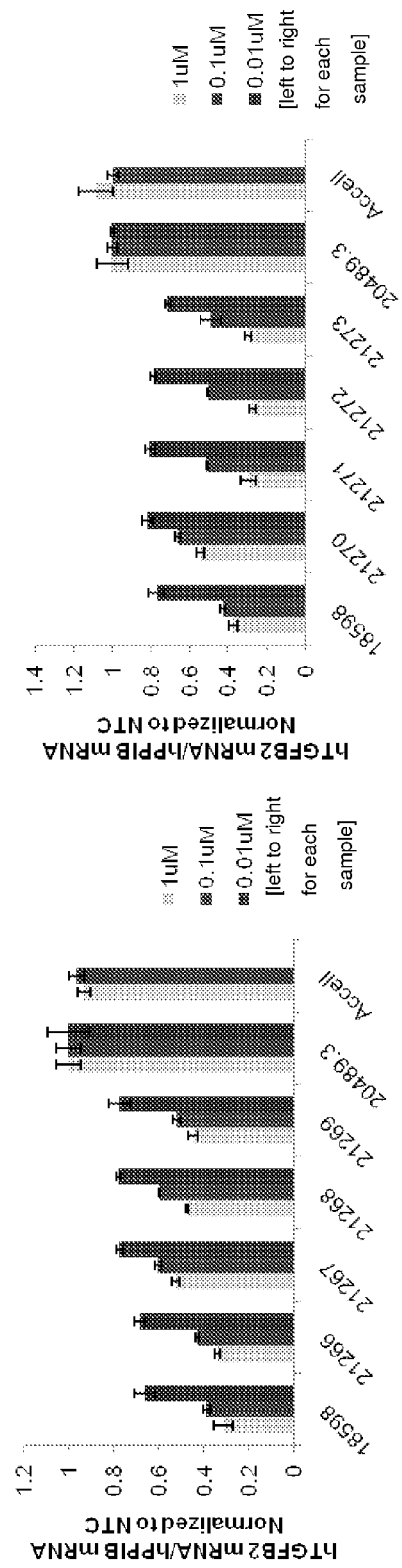
FIG. 63 demonstrates that chemically optimized hTGFB2 L1 sd-rxRNAs are active.
Figure 64:
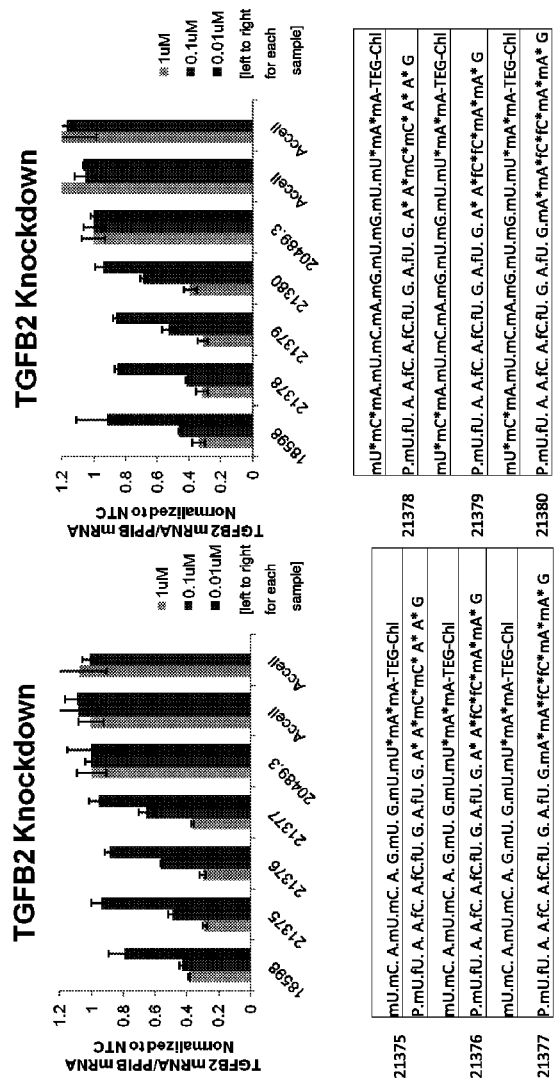
FIG. 64 demonstrates that chemically optimized hTGFB2 sd-rxRNAs are active.

Activity of PTGS2, TGFβ1 and TGFβ2 leads was also tested. FIGS. 59 and 60 demonstrate activity of PTGS2 L1 and L2 compounds. FIGS. 61 and 62 demonstrate the activity of hTGFβ1 compounds and FIGS. 63 and 64 demonstrate the activity of hTGFβ2 compounds.

Figure 58:
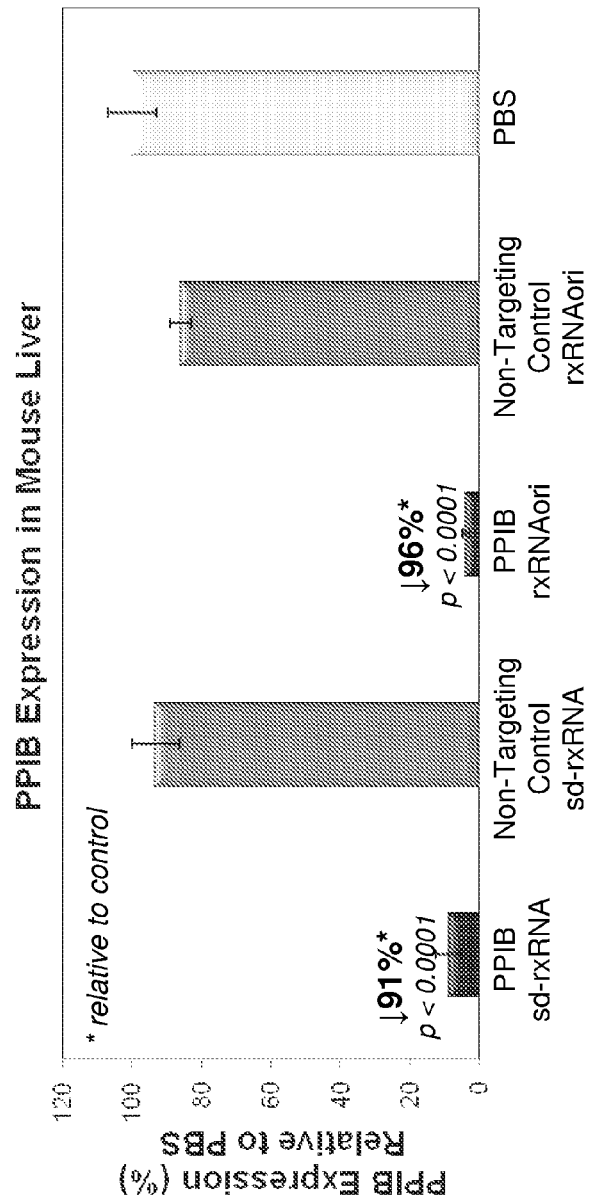
FIG. 58 demonstrates a percent (%) decrease in PPIB expression in the liver relative to PBS control. Lipoid formulated rxRNAs (10 mg/kg) were delivery systemically to Balb/c mice (n=5) by single tail vein injections. Liver tissue was harvested at 24 hours after injection and expression was analyzed by qPCR (normalized to β-actin). Map4K4 rxRNAori also showed significant silencing (~83%, p<0.001) although Map4K4 sd-rxRNA did not significantly reduce target gene expression (~17%, p=0.019). TD.035.2278, Published lipidoid delivery reagent, 98N12-5(1), from Akinc, 2009.

Gene knock-down in liver was also tested following tail vein injection mice. FIG. 58 demonstrates a percent (%) decrease in PPIB expression in the liver relative to PBS control. Lipid formulated rxRNAs (10 mg/kg) were delivery systemically to Balb/c mice (n=5) by single tail vein injections. Liver tissue was harvested at 24 hours after injection and expression was analyzed by qPCR (normalized to β-actin). Map4K4 rxRNAori also showed significant silencing (~83%, p<0.001) although Map4K4 sd-rxRNA did not significantly reduce target gene expression (~17%, p=0.019). TD.035.2278, Published lipidoid delivery reagent, 98N12-5 (1), from Akinc, 2009.

Table 1 provides sequences tested in the Original sd-rxRNA screen.
Table 2 demonstrates inhibition of gene expression with PTGS2 on sequences.
Table 3 demonstrates non-limiting examples of PTGS2 sd-rxRNA sequences.
Table 4 demonstrates non-limiting examples of TGFB1 sd-rxRNA sequences.
Table 5 demonstrates inhibition of gene expression with hTGFB1 ori sequences.
Table 6 demonstrates inhibition of gene expression with hTGFB2 ori sequences.
Table 7 demonstrates non-limiting examples of hTGFB2 sd-rxRNA sequences.
Table 8 demonstrates non-limiting examples of hSPP1 sd-rxRNA sequences.
Table 9 demonstrates inhibition of gene expression with hSPP1 ori sequences.
Table 10 demonstrates non-limiting examples of hCTGF sd-rxRNA sequences.
Table 11 demonstrates inhibition of gene expression with hCTGF on sequences.
Table 12 demonstrates inhibition of gene expression with CTGF on sequences.
Table 13 demonstrates inhibition of gene expression with SPP1 sd-rxRNA sequences.
Table 14 demonstrates inhibition of gene expression with PTGS2 sd-rxRNA sequences.
Table 15 demonstrates inhibition of gene expression with CTGF sd-rxRNA sequences.
Table 16 demonstrates inhibition of gene expression with TGFB2 sd-rxRNA sequences.
Table 17 demonstrates inhibition of gene expression with TGFB1 sd-rxRNA sequences.
Table 18 demonstrates inhibition of gene expression with SPP1 sd-rxRNA sequences.
Table 19 demonstrates inhibition of gene expression with PTGS2 sd-rxRNA sequences.
Table 20 demonstrates inhibition of gene expression with CTGF sd-rxRNA sequences.
Table 21 demonstrates inhibition of gene expression with TGFB2 sd-rxRNA sequences.
Table 22 demonstrates inhibition of gene expression with TGFB1 sd-rxRNA sequences.
Table 23 provides non-limiting examples of CB1 sequences.
Table 24 provides a summary of CTGF Leads.
Table 25 provides a summary of PTGS2 Leads.
Table 26 provides a summary of TGFβ1 Leads.
Table 27 provides a summary of TGFβ1 Leads.

TABLE 1

Original sd-rxRNA screen

| Oligo ID# | G1- | SEQ ID NO | Sense-sd-rxRNA GII | SEQ ID NO | AS-sd-rxRNA-GII |
|---|---|---|---|---|---|
| 14394 | TGFB1 | 1 | GmCmUAAmUGGmUGGAA-chol | 2 | 5'-P-mU(2'-F-U)(2'-F-C)(2'-F-C)A(2'-F-C)(2'-F-C)A(2'-F-U)(2'-F-U)AGmC*A*mC*G*mC*G*G |
| 14395 | TGFB1 | 3 | mUGAmUmCGmUGmCGmCmUmC-chol | 4 | 5'-P-mGAG(2'-F-C)G(2'-F-C)A(2'-F-C)GA(2'-F-U)mCA*mU*G*mU*mU*G*G |

TABLE 1-continued

Original sd-rxRNA screen

| Oligo ID# | G1- | SEQ ID NO | Sense-sd-rxRNA GII | SEQ ID NO | AS-sd-rxRNA-GII |
|---|---|---|---|---|---|
| 14396 | TGFB1 | 5 | mCAAmUmCmCmUGGmCGA-chol | 6 | 5'-P-mU(2'-F-C)G(2'-F-C)(2'-F-C)AGGAA(2'-F-U)mUG*mU*G*mC*mU*G |
| 14397 | TGFB1 | 7 | AGmUGGAmUmCmCAmCGA-chol | 8 | 5'-P-mU(2'-F-C)G(2'-F-U)GGA(2'-F-U)(2'-F-C)(2'-F-C)AmCmU*mU*mC*mC*A*G*C |
| 14398 | TGFB1 | 9 | mUAmCAGmCAAGGmUmCmC-chol | 10 | 5'-P-mGGA(2'-F-C)(2'-F-C)(2'-F-U)(2'-F-U)G(2'-F-C)(2'-F-U)GmUA*mC*mU*G*mC*G*U |
| 14399 | TGFB1 | 11 | AAmCAmUGAmUmCGmUGmC-chol | 12 | 5'-P-mG(2'-F-C)A(2'-F-C)GA(2'-F-U)(2'-F-C)A(2'-F-U)GmUmU*G*G*A*mC*A*G |
| 14400 | TGFB1 | 13 | AmCAmUGAmUmCGmUGmCG-chol | 14 | 5'-P-mCG(2'-F-C)A(2'-F-C)GA(2'-F-U)(2'-F-C)A(2'-F-U)GmU*mU*G*G*A*mC*A |
| 14401 | TGFB1 | 15 | mCAGmCAAGGmUmCmCmUG-chol | 16 | 5'-P-mCAGGA(2'-F-C)(2'-F-C)(2'-F-U)(2'-F-U)G(2'-F-U)(2'-F-C)mUG*mU*A*mC*mU*G*C |
| 14402 | TGFB1 | 17 | mCmCAAmCAmUGAmUmCGmU-chol | 18 | 5'-P-mA(2'-F-C)GA(2'-F-U)(2'-F-C)A(2'-F-U)G(2'-F-U)(2'-F-U)GG*A*mC*A*G*mC*U |
| 14403 | TGFB1 | 19 | AGmCGGAAGmCGmCAmU-chol | 20 | 5'-P-mA(2'-F-U)G(2'-F-C)G(2'-F-U)(2'-F-U)(2'-F-C)(2'-F-C)GmCmU*mU*mC*A*mC*mC*A |
| 14404 | TGFB1 | 21 | GmCAmUmCGAGGmCmCAmU-chol | 22 | 5'-P-mA(2'-F-U)GG(2'-F-C)(2'-F-C)(2'-F-U)(2'-F-C)GA(2'-F-U)GmC*G*mC*mU*mU*mC*C |
| 14405 | TGFB1 | 23 | GAmCmUAmUmCGAmCAmUG-chol | 24 | 5'-P-mCA(2'-F-U)G(2'-F-U)(2'-F-C)GA(2'-F-U)AGmUmC*mU*mU*G*mC*A*G |
| 14406 | TGFB1 | 25 | AmCmCmUGmCAAGAmCmUA-chol | 26 | 5'-P-mUAG(2'-F-U)(2'-F-C)(2'-F-U)(2'-F-U)G(2'-F-C)AGGmU*G*G*A*mU*A*G |
| 14407 | TGFB1 | 27 | GmCmUmCmCAmCGGAGAA-chol | 28 | 5'-P-mU(2'-F-U)(2'-F-C)(2'-F-U)(2'-F-C)(2'-F-C)G(2'-F-U)GGAGmC*mU*G*A*A*G*C |
| 14408 | TGFB2 | 29 | GGmCmUmCmUmCmCmUmUmCGA-chol | 30 | 5'-P-mU(2'-F-C)GAAGGAGAGmCmC*A*mU*mU*mC*G*C |
| 14409 | TGFB2 | 31 | GAmCAGGAAmCmCmUGG-chol | 32 | 5'-P-mC(2'-F-C)AGG(2'-F-U)(2'-F-U)(2'-F-C)(2'-F-C)G(2'-F-U)GmUmC*mU*mU*mU*A*mU*G |
| 14410 | TGFB2 | 33 | mCmCAAGGAGGmUmUmUA-chol | 34 | 5'-P-mUAAA(2'-F-C)(2'-F-C)(2'-F-U)(2'-F-C)(2'-F-C)(2'-F-U)(2'-F-U)GG*mC*G*mU*A*G*U |
| 14411 | TGFB2 | 35 | AmUmUmUmCmCAmUmCmUAmCA-chol | 36 | 5'-P-mUG(2'-F-U)AGA(2'-F-U)GGAAmU*mC*mC*mC*mU*C |
| 14412 | TGFB2 | 37 | mUmCmCAmUmCmUAmCAAmCA-chol | 38 | 5'-P-mUG(2'-F-U)(2'-F-U)G(2'-F-U)AGA(2'-F-U)GGA*A*A*mU*mC*A*C |
| 14413 | TGFB2 | 39 | mUmUmUmCmCAmUmCmUAmCAA-chol | 40 | 5'-P-mU(2'-F-U)G(2'-F-U)(2'-F-U)G(2'-F-U)AGA(2'-F-U)GGAAA*mU*mC*A*mC*mC*U |
| 14414 | TGFB2 | 41 | mCGmCmCAAGGAGGmUrnU-chol | 42 | 5'-P-mAA(2'-F-C)(2'-F-C)(2'-F-U)(2'-F-C)(2'-F-C)(2'-F-U)(2'-F-U)GGmCG*mU*A*G*mU*A*C |

TABLE 1-continued

Original sd-rxRNA screen

| Oligo ID# | G1- | SEQ ID NO | Sense-sd-rxRNA GII | SEQ ID NO | AS-sd-rxRNA-GII |
|---|---|---|---|---|---|
| 14415 | TGFB2 | 43 | GmUGGmUGAmUmCAGAA-chol | 44 | 5'-P-mU(2'-F-U)(2'-F-C)(2'-F-U)GA(2'-F-U)(2'-F-C)A(2'-F-C)(2'-F-C)AmC*mU*G*G*mU*A*U |
| 14416 | TGFB2 | 45 | mCmUmCmCmUGmCmUAAmUGmU-chol | 46 | 5'-P-mA(2'-F-C)A(2'-F-U)(2'-F-U)AG(2'-F-C)AGGAG*A*mU*G*mU*G*G |
| 14417 | TGFB2 | 47 | AmCmCmUmCmCAmCAmUAmUA-chol | 48 | 5'-P-mUA(2'-F-U)A(2'-F-U)G(2'-F-U)GGAGGmU*G*mC*mC*A*mU*C |
| 14418 | TGFB2 | 49 | AAGmUmCmCAmCmUAGGA-chol | 50 | 5'-P-mU(2'-F-C)(2'-F-C)(2'-F-U)AG(2'-F-U)GGA(2'-F-C)mUmU*mU*A*mU*A*G*U |
| 14419 | TGFB2 | 51 | mUGGmUGAmUmCAGAAA-chol | 52 | 5'-P-m U(2'-F-U)(2'-F-U)(2'-F-C)(2'-F-U)GA(2'-F-U)(2'-F-C)A(2'-F-C)mCA*mC*mU*G*G*mU*A |
| 14420 | TGFB2 | 53 | AGmUmCmCAmCmUAGGAA-chol | 54 | 5'-P-m U(2'-F-U)(2'-F-C)(2'-F-C)(2'-F-U)AG(2'-F-U)GGAmCmU*mU*mU*A*mU*A*G |
| 14421 | TGFB2 | 55 | AmCGmCmCAAGGAGGmU-chol | 56 | 5'-P-mA(2'-F-C)(2'-F-C)(2'-F-U)(2'-F-C)(2'-F-C)(2'-F-U)(2'-F-U)GG(2'-F-C)GmU*A*mU*A*mC*U |
| 14422 | PTGS2 | 57 | mCAmCAmUmUmUGAmUmUGA-chol | 58 | 5'-P-mU(2'-F-C)AA(2'-F-U)(2'-F-C)AAA(2'-F-U)GmUG*A*mU*mC*mU*G*G |
| 14423 | PTGS2 | 59 | mCAmCmUGmCmCmUmCAAmUmU-chol | 60 | 5'-P-mAA(2'-F-U)(2'-F-U)GAGG(2'-F-C)AGmUG*mU*mU*G*A*mU*G |
| 14424 | PTGS2 | 61 | AAAmUAmCmCAGmUmCmUmU-chol | 62 | 5'-P-mAAGA(2'-F-C)(2'-F-U)GG(2'-F-U)A(2'-F-U)mUmU*mC*A*mU*mC*mU*G |
| 14425 | PTGS2 | 63 | mCAmUmUmUGAmUmUGAmCA-chol | 64 | 5'-P-mUG(2'-F-U)(2'-F-C)AA(2'-F-U)(2'-F-C)AAAmUG*mU*G*A*mU*mC*U |

TABLE 2

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15147 | CDS | 176 | 65 | CCUGGCGCUCAGCCAUACAGCAAAA | 59% |
| 15148 | CDS | 177 | 66 | CUGGCGCUCAGCCAUACAGCAAAUA | 72% |
| 15149 | CDS | 178 | 67 | UGGCGCUCAGCCAUACAGCAAAUCA | 77% |
| 15150 | CDS | 180 | 68 | GCGCUCAGCCAUACAGCAAAUCCUA | 70% |
| 15151 | CDS | 182 | 69 | GCUCAGCCAUACAGCAAAUCCUUGA | 76% |
| 15152 | CDS | 183 | 70 | CUCAGCCAUACAGCAAAUCCUUGCA | 74% |
| 15153 | CDS | 184 | 71 | UCAGCCAUACAGCAAAUCCUUGCUA | 47% |
| 15154 | CDS | 186 | 72 | AGCCAUACAGCAAAUCCUUGCUGUA | 55% |
| 15155 | CDS | 187 | 73 | GCCAUACAGCAAAUCCUUGCUGUUA | 41% |
| 15156 | CDS | 188 | 74 | CCAUACAGCAAAUCCUUGCUGUUCA | 46% |
| 15157 | CDS | 212 | 75 | CCACCCAUGUCAAAACCGAGGUGUA | 31% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15158 | CDS | 243 | 76 | AGUGUGGGAUUUGACCAGUAUAAGA | 23% |
| 15159 | CDS | 244 | 77 | GUGUGGGAUUUGACCAGUAUAAGUA | 24% |
| 15160 | CDS | 245 | 78 | UGUGGGAUUUGACCAGUAUAAGUGA | 38% |
| 15161 | CDS | 252 | 79 | UUUGACCAGUAUAAGUGCGAUUGUA | 29% |
| 15162 | CDS | 285 | 80 | GGAUUCUAUGGAGAAAACUGCUCAA | 16% |
| 15163 | CDS | 337 | 81 | UAUUUCUGAAACCCACUCCAAACAA | 32% |
| 15164 | CDS | 338 | 82 | AUUUCUGAAACCCACUCCAAACACA | 21% |
| 15165 | CDS | 339 | 83 | UUUCUGAAACCCACUCCAAACACAA | 21% |
| 15166 | CDS | 340 | 84 | UUCUGAAACCCACUCCAAACACAGA | 45% |
| 15167 | CDS | 345 | 85 | AAACCCACUCCAAACACAGUGCACA | 87% |
| 15168 | CDS | 347 | 86 | ACCCACUCCAAACACAGUGCACUAA | 83% |
| 15169 | CDS | 349 | 87 | CCACUCCAAACACAGUGCACUACAA | 51% |
| 15170 | CDS | 350 | 88 | CACUCCAAACACAGUGCACUACAUA | 31% |
| 15171 | CDS | 394 | 89 | UUUGGAACGUUGUGAAUAACAUUCA | 43% |
| 15172 | CDS | 406 | 90 | UGAAUAACAUUCCCUUCCUUCGAAA | 21% |
| 15173 | CDS | 407 | 91 | GAAUAACAUUCCCUUCCUUCGAAAA | 32% |
| 15174 | CDS | 408 | 92 | AAUAACAUUCCCUUCCUUCGAAAUA | 27% |
| 15175 | CDS | 435 | 93 | AUUAUGAGUUAUGUGUUGACAUCCA | 27% |
| 15176 | CDS | 437 | 94 | UAUGAGUUAUGUGUUGACAUCCAGA | 21% |
| 15177 | CDS | 439 | 95 | UGAGUUAUGUGUUGACAUCCAGAUA | 30% |
| 15178 | CDS | 440 | 96 | GAGUUAUGUGUUGACAUCCAGAUCA | 68% |
| 15179 | CDS | 441 | 97 | AGUUAUGUGUUGACAUCCAGAUCAA | 35% |
| 15180 | CDS | 442 | 98 | GUUAUGUGUUGACAUCCAGAUCACA | 36% |
| 15181 | CDS | 443 | 99 | UUAUGUGUUGACAUCCAGAUCACAA | 51% |
| 15182 | CDS | 444 | 100 | UAUGUGUUGACAUCCAGAUCACAUA | 24% |
| 15183 | CDS | 445 | 101 | AUGUGUUGACAUCCAGAUCACAUUA | 37% |
| 15184 | CDS | 446 | 102 | UGUGUUGACAUCCAGAUCACAUUUA | 42% |
| 15185 | CDS | 448 | 103 | UGUUGACAUCCAGAUCACAUUUGAA | 18% |
| 15186 | CDS | 449 | 104 | GUUGACAUCCAGAUCACAUUUGAUA | 24% |
| 15187 | CDS | 450 | 105 | UUGACAUCCAGAUCACAUUUGAUUA | 25% |
| 15188 | CDS | 452 | 106 | GACAUCCAGAUCACAUUUGAUUGAA | 27% |
| 15189 | CDS | 454 | 107 | CAUCCAGAUCACAUUUGAUUGACAA | 27% |
| 15190 | CDS | 455 | 108 | AUCCAGAUCACAUUUGAUUGACAGA | 32% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15191 | CDS | 456 | 109 | UCCAGAUCACAUUUGAUUGACAGUA | 40% |
| 15192 | CDS | 457 | 110 | CCAGAUCACAUUUGAUUGACAGUCA | 52% |
| 15193 | CDS | 460 | 111 | GAUCACAUUUGAUUGACAGUCCACA | 40% |
| 15194 | CDS | 461 | 112 | AUCACAUUUGAUUGACAGUCCACCA | 46% |
| 15195 | CDS | 462 | 113 | UCACAUUUGAUUGACAGUCCACCAA | 34% |
| 15196 | CDS | 463 | 114 | CACAUUUGAUUGACAGUCCACCAAA | 30% |
| 15197 | CDS | 464 | 115 | ACAUUUGAUUGACAGUCCACCAACA | 32% |
| 15198 | CDS | 465 | 116 | CAUUUGAUUGACAGUCCACCAACUA | 44% |
| 15199 | CDS | 467 | 117 | UUUGAUUGACAGUCCACCAACUUAA | 17% |
| 15200 | CDS | 468 | 118 | UUGAUUGACAGUCCACCAACUUACA | 22% |
| 15201 | CDS | 469 | 119 | UGAUUGACAGUCCACCAACUUACAA | 27% |
| 15202 | CDS | 470 | 120 | GAUUGACAGUCCACCAACUUACAAA | 41% |
| 15203 | CDS | 471 | 121 | AUUGACAGUCCACCAACUUACAAUA | 39% |
| 15204 | CDS | 472 | 122 | UUGACAGUCCACCAACUUACAAUGA | 61% |
| 15205 | CDS | 473 | 123 | UGACAGUCCACCAACUUACAAUGCA | 48% |
| 15206 | CDS | 479 | 124 | UCCACCAACUUACAAUGCUGACUAA | 29% |
| 15207 | CDS | 486 | 125 | ACUUACAAUGCUGACUAUGGCUACA | 35% |
| 15208 | CDS | 488 | 126 | UUACAAUGCUGACUAUGGCUACAAA | 32% |
| 15209 | CDS | 517 | 127 | GGGAAGCCUUCUCUAACCUCUCCUA | 39% |
| 15210 | CDS | 518 | 128 | GGAAGCCUUCUCUAACCUCUCCUAA | 48% |
| 15211 | CDS | 519 | 129 | GAAGCCUUCUCUAACCUCUCCUAUA | 19% |
| 15212 | CDS | 520 | 130 | AAGCCUUCUCUAACCUCUCCUAUUA | 17% |
| 15213 | CDS | 524 | 131 | CUUCUCUAACCUCUCCUAUUAUACA | 17% |
| 15214 | CDS | 525 | 132 | UUCUCUAACCUCUCCUAUUAUACUA | 34% |
| 15215 | CDS | 526 | 133 | UCUCUAACCUCUCCUAUUAUACUAA | 49% |
| 15216 | CDS | 601 | 134 | GUAAAAGCAGCUUCCUGAUUCAAA | 35% |
| 15217 | CDS | 602 | 135 | UAAAAAGCAGCUUCCUGAUUCAAAA | 25% |
| 15218 | CDS | 606 | 136 | AAGCAGCUUCCUGAUUCAAAUGAGA | 27% |
| 15219 | CDS | 615 | 137 | CCUGAUUCAAAUGAGAUUGUGGAAA | 37% |
| 15220 | CDS | 616 | 138 | CUGAUUCAAAUGAGAUUGUGGAAAA | 27% |
| 15221 | CDS | 636 | 139 | GAAAAUUGCUUCUAAGAAGAAAGA | 37% |
| 15222 | CDS | 637 | 140 | AAAAUUGCUUCUAAGAAGAAAGUA | 56% |
| 15223 | CDS | 638 | 141 | AAAUUGCUUCUAAGAAGAAAGUUA | 25% |
| 15224 | CDS | 639 | 142 | AAAUUGCUUCUAAGAAGAAAGUUCA | 34% |
| 15225 | CDS | 678 | 143 | GGCUCAAACAUGAUGUUUGCAUUCA | 68% |
| 15226 | CDS | 679 | 144 | GCUCAAACAUGAUGUUUGCAUUCUA | 51% |
| 15227 | CDS | 680 | 145 | CUCAAACAUGAUGUUUGCAUUCUUA | 50% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15228 | CDS | 682 | 146 | CAAACAUGAUGUUUGCAUUCUUUGA | 51% |
| 15229 | CDS | 683 | 147 | AAACAUGAUGUUUGCAUUCUUUGCA | 63% |
| 15230 | CDS | 722 | 148 | UCAGUUUUCAAGACAGAUCAUAAA | 45% |
| 15231 | CDS | 723 | 149 | CAGUUUUCAAGACAGAUCAUAAGA | 59% |
| 15232 | CDS | 724 | 150 | AGUUUUCAAGACAGAUCAUAAGCA | 80% |
| 15233 | CDS | 725 | 151 | GUUUUCAAGACAGAUCAUAAGCGA | 55% |
| 15234 | CDS | 726 | 152 | UUUUCAAGACAGAUCAUAAGCGAA | 53% |
| 15235 | CDS | 776 | 153 | CCAUGGGUGGACUUAAAUCAUAUA | 56% |
| 15236 | CDS | 787 | 154 | ACUUAAAUCAUAUUUACGGUGAAAA | 63% |
| 15237 | CDS | 788 | 155 | CUUAAAUCAUAUUUACGGUGAAACA | 43% |
| 15238 | CDS | 789 | 156 | UUAAAUCAUAUUUACGGUGAAACUA | 48% |
| 15239 | CDS | 790 | 157 | UAAAUCAUAUUUACGGUGAAACUCA | 56% |
| 15240 | CDS | 792 | 158 | AAUCAUAUUUACGGUGAAACUCUGA | 46% |
| 15241 | CDS | 793 | 159 | AUCAUAUUUACGGUGAAACUCUGGA | 64% |
| 15242 | CDS | 799 | 160 | UUUACGGUGAAACUCUGGCUAGACA | 35% |
| 15243 | CDS | 819 | 161 | AGACAGCGUAAACUGCGCCUUUUCA | 65% |
| 15244 | CDS | 820 | 162 | GACAGCGUAAACUGCGCCUUUUCAA | 51% |
| 15245 | CDS | 821 | 163 | ACAGCGUAAACUGCGCCUUUUCAAA | 48% |
| 15246 | CDS | 822 | 164 | CAGCGUAAACUGCGCCUUUUCAAGA | 61% |
| 15247 | CDS | 823 | 165 | AGCGUAAACUGCGCCUUUUCAAGGA | 48% |
| 15248 | CDS | 828 | 166 | AAACUGCGCCUUUUCAAGGAUGGAA | 42% |
| 15249 | CDS | 830 | 167 | ACUGCGCCUUUUCAAGGAUGGAAAA | 29% |
| 15250 | CDS | 861 | 168 | UAUCAGAUAAUUGAUGGAGAGAUGA | 32% |
| 15251 | CDS | 862 | 169 | AUCAGAUAAUUGAUGGAGAGAUGUA | 55% |
| 15252 | CDS | 863 | 170 | UCAGAUAAUUGAUGGAGAGAUGUAA | 50% |
| 15253 | CDS | 864 | 171 | CAGAUAAUUGAUGGAGAGAUGUAUA | 50% |
| 15254 | CDS | 865 | 172 | AGAUAAUUGAUGGAGAGAUGUAUCA | 55% |
| 15255 | CDS | 866 | 173 | GAUAAUUGAUGGAGAGAUGUAUCCA | 65% |
| 15256 | CDS | 867 | 174 | AUAAUUGAUGGAGAGAUGUAUCCUA | 54% |
| 15257 | CDS | 880 | 175 | AGAUGUAUCCUCCCACAGUCAAAGA | 78% |
| 15258 | CDS | 881 | 176 | GAUGUAUCCUCCCACAGUCAAAGAA | 79% |
| 15259 | CDS | 882 | 177 | AUGUAUCCUCCCACAGUCAAAGAUA | 49% |
| 15260 | CDS | 883 | 178 | UGUAUCCUCCCACAGUCAAAGAUAA | 28% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15261 | CDS | 884 | 179 | GUAUCCUCCCACAGUCAAAGAUACA | 56% |
| 15262 | CDS | 885 | 180 | UAUCCUCCCACAGUCAAAGAUACUA | 42% |
| 15263 | CDS | 887 | 181 | UCCUCCCACAGUCAAAGAUACUCAA | 45% |
| 15264 | CDS | 888 | 182 | CCUCCCACAGUCAAAGAUACUCAGA | 73% |
| 15265 | CDS | 889 | 183 | CUCCCACAGUCAAAGAUACUCAGGA | 56% |
| 15266 | CDS | 891 | 184 | CCCACAGUCAAAGAUACUCAGGCAA | 80% |
| 15267 | CDS | 901 | 185 | AAGAUACUCAGGCAGAGAUGAUCUA | 59% |
| 15268 | CDS | 935 | 186 | AGUCCCUGAGCAUCUACGGUUUGCA | 83% |
| 15269 | CDS | 980 | 187 | UCUGGUGCCUGGUCUGAUGAUGUAA | 55% |
| 15270 | CDS | 981 | 188 | CUGGUGCCUGGUCUGAUGAUGUAUA | 56% |
| 15271 | CDS | 982 | 189 | UGGUGCCUGGUCUGAUGAUGUAUGA | 43% |
| 15272 | CDS | 983 | 190 | GGUGCCUGGUCUGAUGAUGUAUGCA | 41% |
| 15273 | CDS | 984 | 191 | GUGCCUGGUCUGAUGAUGUAUGCCA | 42% |
| 15274 | CDS | 985 | 192 | UGCCUGGUCUGAUGAUGUAUGCCAA | 37% |
| 15275 | CDS | 986 | 193 | GCCUGGUCUGAUGAUGUAUGCCACA | 61% |
| 15276 | CDS | 1016 | 194 | GCUGCGGGAACACAACAGAGUAUGA | 44% |
| 15277 | CDS | 1019 | 195 | GCGGGAACACAACAGAGUAUGCGAA | 33% |
| 15278 | CDS | 1038 | 196 | UGCGAUGUGCUUAAACAGGAGCAUA | 53% |
| 15279 | CDS | 1039 | 197 | GCGAUGUGCUUAAACAGGAGCAUCA | 109% |
| 15280 | CDS | 1040 | 198 | CGAUGUGCUUAAACAGGAGCAUCCA | 77% |
| 15281 | CDS | 1042 | 199 | AUGUGCUUAAACAGGAGCAUCCUGA | 69% |
| 15282 | CDS | 1043 | 200 | UGUGCUUAAACAGGAGCAUCCUGAA | 76% |
| 15283 | CDS | 1044 | 201 | GUGCUUAAACAGGAGCAUCCUGAAA | 65% |
| 15284 | CDS | 1045 | 202 | UGCUUAAACAGGAGCAUCCUGAAUA | 64% |
| 15285 | CDS | 1084 | 203 | UGUUCCAGACAAGCAGGCUAAUACA | 41% |
| 15286 | CDS | 1093 | 204 | CAAGCAGGCUAAUACUGAUAGGAGA | 24% |
| 15287 | CDS | 1095 | 205 | AGCAGGCUAAUACUGAUAGGAGAGA | 50% |
| 15288 | CDS | 1096 | 206 | GCAGGCUAAUACUGAUAGGAGAGAA | 51% |
| 15289 | CDS | 1124 | 207 | UAAGAUUGUGAUUGAAGAUUAUGUA | 35% |
| 15290 | CDS | 1125 | 208 | AAGAUUGUGAUUGAAGAUUAUGUGA | 34% |
| 15291 | CDS | 1126 | 209 | AGAUUGUGAUUGAAGAUUAUGUGCA | 59% |
| 15292 | CDS | 1127 | 210 | GAUUGUGAUUGAAGAUUAUGUGCAA | 41% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15293 | CDS | 1128 | 211 | AUUGUGAUUGAAGAUUAUGUGCAAA | 51% |
| 15294 | CDS | 1129 | 212 | UUGUGAUUGAAGAUUAUGUGCAACA | 45% |
| 15295 | CDS | 1131 | 213 | GUGAUUGAAGAUUAUGUGCAACACA | 37% |
| 15296 | CDS | 1132 | 214 | UGAUUGAAGAUUAUGUGCAACACUA | 34% |
| 15297 | CDS | 1134 | 215 | AUUGAAGAUUAUGUGCAACACUUGA | 24% |
| 15298 | CDS | 1136 | 216 | UGAAGAUUAUGUGCAACACUUGAGA | 37% |
| 15299 | CDS | 1138 | 217 | AAGAUUAUGUGCAACACUUGAGUGA | 44% |
| 15300 | CDS | 1145 | 218 | UGUGCAACACUUGAGUGGCUAUCAA | 29% |
| 15301 | CDS | 1149 | 219 | CAACACUUGAGUGGCUAUCACUUCA | 33% |
| 15302 | CDS | 1179 | 220 | AAAUUUGACCCAGAACUACUUUUCA | 35% |
| 15303 | CDS | 1180 | 221 | AAUUUGACCCAGAACUACUUUUCAA | 41% |
| 15304 | CDS | 1181 | 222 | AUUUGACCCAGAACUACUUUUCAAA | 40% |
| 15305 | CDS | 1200 | 223 | UUCAACAAACAAUUCCAGUACCAAA | 49% |
| 15306 | CDS | 1211 | 224 | AUUCCAGUACCAAAAUCGUAUUGCA | 27% |
| 15307 | CDS | 1217 | 225 | GUACCAAAAUCGUAUUGCUGCUGAA | 31% |
| 15308 | CDS | 1270 | 226 | UUCUGCCUGACACCUUUCAAAUUCA | 35% |
| 15309 | CDS | 1280 | 227 | CACCUUUCAAAUUCAUGACCAGAAA | 57% |
| 15310 | CDS | 1284 | 228 | UUUCAAAUUCAUGACCAGAAAUACA | 42% |
| 15311 | CDS | 1289 | 229 | AAUUCAUGACCAGAAAUACAACUAA | 52% |
| 15312 | CDS | 1327 | 230 | ACAACAACUCUAUAUUGCUGGAACA | 58% |
| 15313 | CDS | 1352 | 231 | UGGAAUUACCCAGUUUGUUGAAUCA | 35% |
| 15314 | CDS | 1356 | 232 | AUUACCCAGUUUGUUGAAUCAUUCA | 41% |
| 15315 | CDS | 1357 | 233 | UUACCCAGUUUGUUGAAUCAUUCAA | 58% |
| 15316 | CDS | 1359 | 234 | ACCCAGUUUGUUGAAUCAUUCACCA | 52% |
| 15317 | CDS | 1360 | 235 | CCCAGUUUGUUGAAUCAUUCACCAA | 66% |
| 15318 | CDS | 1361 | 236 | CCAGUUUGUUGAAUCAUUCACCAGA | 54% |
| 15319 | CDS | 1365 | 237 | UUUGUUGAAUCAUUCACCAGGCAAA | 47% |
| 15320 | CDS | 1462 | 238 | AGAGCAGGCAGAUGAAAUACCAGUA | 65% |
| 15321 | CDS | 1463 | 239 | GAGCAGGCAGAUGAAAUACCAGUCA | 66% |
| 15322 | CDS | 1465 | 240 | GCAGGCAGAUGAAAUACCAGUCUUA | 22% |
| 15323 | CDS | 1466 | 241 | CAGGCAGAUGAAAUACCAGUCUUUA | 43% |
| 15324 | CDS | 1472 | 242 | GAUGAAAUACCAGUCUUUAAUGAA | 23% |
| 15325 | CDS | 1473 | 243 | AUGAAAUACCAGUCUUUAAUGAGA | 61% |
| 15326 | CDS | 1474 | 244 | UGAAAUACCAGUCUUUAAUGAGUA | 49% |
| 15327 | CDS | 1475 | 245 | GAAAUACCAGUCUUUAAUGAGUAA | 76% |
| 15328 | CDS | 1476 | 246 | AAAUACCAGUCUUUAAUGAGUACA | 51% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15329 | CDS | 1477 | 247 | AAUACCAGUCUUUUAAUGAGUACCA | 72% |
| 15330 | CDS | 1478 | 248 | AUACCAGUCUUUUAAUGAGUACCGA | 40% |
| 15331 | CDS | 1479 | 249 | UACCAGUCUUUUAAUGAGUACCGCA | 53% |
| 15332 | CDS | 1480 | 250 | ACCAGUCUUUUAAUGAGUACCGCAA | 39% |
| 15333 | CDS | 1481 | 251 | CCAGUCUUUUAAUGAGUACCGCAAA | 41% |
| 15334 | CDS | 1483 | 252 | AGUCUUUUAAUGAGUACCGCAAACA | 38% |
| 15335 | CDS | 1485 | 253 | UCUUUUAAUGAGUACCGCAAACGCA | 55% |
| 15336 | CDS | 1486 | 254 | CUUUUAAUGAGUACCGCAAACGCUA | 63% |
| 15337 | CDS | 1487 | 255 | UUUUAAUGAGUACCGCAAACGCUUA | 52% |
| 15338 | CDS | 1495 | 256 | AGUACCGCAAACGCUUUAUGCUGAA | 49% |
| 15339 | CDS | 1524 | 257 | UAUGAAUCAUUUGAAGAACUUACAA | 65% |
| 15340 | CDS | 1525 | 258 | AUGAAUCAUUUGAAGAACUUACAGA | 63% |
| 15341 | CDS | 1527 | 259 | GAAUCAUUUGAAGAACUUACAGGAA | 65% |
| 15342 | CDS | 1529 | 260 | AUCAUUUGAAGAACUUACAGGAGAA | 43% |
| 15343 | CDS | 1531 | 261 | CAUUUGAAGAACUUACAGGAGAAAA | 63% |
| 15344 | CDS | 1532 | 262 | AUUUGAAGAACUUACAGGAGAAAAA | 33% |
| 15345 | CDS | 1574 | 263 | GGAAGCACUCUAUGGUGACAUCGAA | 62% |
| 15346 | CDS | 1609 | 264 | UGUAUCCUGCCCUUCUGGUAGAAAA | 36% |
| 15347 | CDS | 1614 | 265 | CCUGCCCUUCUGGUAGAAAAGCCUA | 58% |
| 15348 | CDS | 1650 | 266 | AUCUUUGGUGAAACCAUGGUAGAAA | 60% |
| 15349 | CDS | 1666 | 267 | UGGUAGAAGUUGGAGCACCAUUCUA | 88% |
| 15350 | CDS | 1669 | 268 | UAGAAGUUGGAGCACCAUUCUCCUA | 85% |
| 15351 | CDS | 1672 | 269 | AAGUUGGAGCACCAUUCUCCUUGAA | 83% |
| 15352 | CDS | 1675 | 270 | UUGGAGCACCAUUCUCCUUGAAAGA | 85% |
| 15353 | CDS | 1676 | 271 | UGGAGCACCAUUCUCCUUGAAAGGA | 83% |
| 15354 | CDS | 1677 | 272 | GGAGCACCAUUCUCCUUGAAAGGAA | 74% |
| 15355 | CDS | 1678 | 273 | GAGCACCAUUCUCCUUGAAAGGACA | 81% |
| 15356 | CDS | 1679 | 274 | AGCACCAUUCUCCUUGAAAGGACUA | 86% |
| 15357 | CDS | 1680 | 275 | GCACCAUUCUCCUUGAAAGGACUUA | 98% |
| 15358 | CDS | 1681 | 276 | CACCAUUCUCCUUGAAAGGACUUAA | 78% |
| 15359 | CDS | 1682 | 277 | ACCAUUCUCCUUGAAAGGACUUAUA | 88% |
| 15360 | CDS | 1683 | 278 | CCAUUCUCCUUGAAAGGACUUAUGA | 88% |
| 15361 | CDS | 1762 | 279 | UGGGUUUUCAAAUCAUCAACACUGA | 78% |
| 15362 | CDS | 1763 | 280 | GGGUUUUCAAAUCAUCAACACUGCA | 92% |
| 15363 | CDS | 1767 | 281 | UUUCAAAUCAUCAACACUGCCUCAA | 85% |
| 15364 | CDS | 1770 | 282 | CAAAUCAUCAACACUGCCUCAAUUA | 84% |
| 15365 | CDS | 1773 | 283 | AUCAUCAACACUGCCUCAAUUCAGA | 86% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15366 | CDS | 1774 | 284 | UCAUCAACACUGCCUCAAUUCAGUA | 94% |
| 15367 | CDS | 1775 | 285 | CAUCAACACUGCCUCAAUUCAGUCA | 84% |
| 15368 | CDS | 1776 | 286 | AUCAACACUGCCUCAAUUCAGUCUA | 84% |
| 15369 | CDS | 1777 | 287 | UCAACACUGCCUCAAUUCAGUCUCA | 68% |
| 15370 | CDS | 1778 | 288 | CAACACUGCCUCAAUUCAGUCUCUA | 73% |
| 15371 | CDS | 1779 | 289 | AACACUGCCUCAAUUCAGUCUCUCA | 79% |
| 15372 | CDS | 1780 | 290 | ACACUGCCUCAAUUCAGUCUCUCAA | 78% |
| 15373 | CDS | 1781 | 291 | CACUGCCUCAAUUCAGUCUCUCAUA | 92% |
| 15374 | CDS | 1782 | 292 | ACUGCCUCAAUUCAGUCUCUCAUCA | 89% |
| 15375 | CDS | 1783 | 293 | CUGCCUCAAUUCAGUCUCUCAUCUA | 95% |
| 15376 | CDS | 1784 | 294 | UGCCUCAAUUCAGUCUCUCAUCUGA | 83% |
| 15377 | CDS | 1785 | 295 | GCCUCAAUUCAGUCUCUCAUCUGCA | 46% |
| 15378 | CDS | 1786 | 296 | CCUCAAUUCAGUCUCUCAUCUGCAA | 51% |
| 15379 | CDS | 1787 | 297 | CUCAAUUCAGUCUCUCAUCUGCAAA | 61% |
| 15380 | CDS | 1790 | 298 | AAUUCAGUCUCUCAUCUGCAAUAAA | 30% |
| 15381 | CDS | 1791 | 299 | AUUCAGUCUCUCAUCUGCAAUAACA | 32% |
| 15382 | CDS | 1792 | 300 | UUCAGUCUCUCAUCUGCAAUAACGA | 30% |
| 15383 | CDS | 1793 | 301 | UCAGUCUCUCAUCUGCAAUAACGUA | 38% |
| 15384 | CDS | 1794 | 302 | CAGUCUCUCAUCUGCAAUAACGUGA | 67% |
| 15385 | CDS | 1795 | 303 | AGUCUCUCAUCUGCAAUAACGUGAA | 71% |
| 15386 | CDS | 1796 | 304 | GUCUCUCAUCUGCAAUAACGUGAAA | 81% |
| 15387 | CDS | 1856 | 305 | AGAGCUCAUUAAAACAGUCACCAUA | 33% |
| 15388 | CDS | 1857 | 306 | GAGCUCAUUAAAACAGUCACCAUCA | 55% |
| 15389 | CDS | 1858 | 307 | AGCUCAUUAAAACAGUCACCAUCAA | 31% |
| 15390 | CDS | 1859 | 308 | GCUCAUUAAAACAGUCACCAUCAAA | 46% |
| 15391 | CDS | 1860 | 309 | CUCAUUAAAACAGUCACCAUCAAUA | 43% |
| 15392 | CDS | 1861 | 310 | UCAUUAAAACAGUCACCAUCAAUGA | 58% |
| 15393 | CDS | 1862 | 311 | CAUUAAAACAGUCACCAUCAAUGCA | 78% |
| 15394 | CDS | 1864 | 312 | UUAAAACAGUCACCAUCAAUGCAAA | 41% |
| 15395 | CDS | 1865 | 313 | UAAAACAGUCACCAUCAAUGCAAGA | 80% |
| 15396 | CDS | 1866 | 314 | AAAACAGUCACCAUCAAUGCAAGUA | 79% |
| 15397 | CDS | 1868 | 315 | AACAGUCACCAUCAAUGCAAGUUCA | 34% |
| 15398 | CDS | 1912 | 316 | AUAUCAAUCCCACAGUACUACUAAA | 39% |
| 15399 | CDS | 1928 | 317 | ACUACUAAAAGAACGUUCGACUGAA | 39% |
| 15400 | CDS/3UTR | 1941 | 318 | CGUUCGACUGAACUGUAGAAGUCUA | 30% |
| 15401 | CDS/3UTR | 1946 | 319 | GACUGAACUGUAGAAGUCUAAUGAA | 25% |
| 15402 | CDS/3UTR | 1949 | 320 | UGAACUGUAGAAGUCUAAUGAUCAA | 29% |
| 15403 | 3UTR | 2077 | 321 | UCCUGUUGCGGAGAAAGGAGUCAUA | 45% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15404 | 3UTR | 2082 | 322 | UUGCGGAGAAAGGAGUCAUACUUGA | 43% |
| 15405 | 3UTR | 2098 | 323 | CAUACUUGUGAAGACUUUUAUGUCA | 30% |
| 15406 | 3UTR | 2128 | 324 | CUAAAGAUUUUGCUGUUGCUGUUAA | 41% |
| 15407 | 3UTR | 2141 | 325 | UGUUGCUGUUAAGUUUGGAAAACAA | 29% |
| 15408 | 3UTR | 2188 | 326 | AGAGAGAAAUGAGUUUUGACGUCUA | 26% |
| 15409 | 3UTR | 2235 | 327 | UUAUAAGAACGAAAGUAAAGAUGUA | 33% |
| 15410 | 3UTR | 2281 | 328 | AAGAUGGCAAAAUGCUGAAAGUUUA | 28% |
| 15411 | 3UTR | 2305 | 329 | UUACACUGUCGAUGUUUCCAAUGCA | 46% |
| 15412 | 3UTR | 2446 | 330 | GACAUUACCAGUAAUUUCAUGUCUA | 24% |
| 15413 | 3UTR | 2581 | 331 | CAAAAGAAGCUGUCUUGGAUUUAA | 36% |
| 15414 | 3UTR | 2669 | 332 | CUUUUUCACCAAGAGUAUAAACCUA | 41% |
| 15415 | 3UTR | 2730 | 333 | AUGCCAAAUUUAUUAAGGUGGUGGA | 61% |
| 15416 | 3UTR | 2750 | 334 | GUGGAGCCACUGCAGUGUUAUCUUA | 39% |
| 15417 | 3UTR | 2752 | 335 | GGAGCCACUGCAGUGUUAUCUUAAA | 45% |
| 15418 | 3UTR | 2802 | 336 | CAGAAUUUGUUUAUAUGGCUGGUAA | 49% |
| 15419 | 3UTR | 2810 | 337 | GUUUAUAUGGCUGGUAACAUGUAAA | 34% |
| 15420 | 3UTR | 2963 | 338 | UACUCAGAUUUUGCUAUGAGGUUAA | 42% |
| 15421 | 3UTR | 2967 | 339 | CAGAUUUUGCUAUGAGGUUAAUGAA | 39% |
| 15422 | 3UTR | 2970 | 340 | AUUUUGCUAUGAGGUUAAUGAAGUA | 43% |
| 15423 | 3UTR | 2986 | 341 | AAUGAAGUACCAAGCUGUGCUUGAA | 40% |
| 15424 | 3UTR | 3064 | 342 | AUCACAUUGCAAAAGUAGCAAUGAA | 59% |
| 15425 | 3UTR | 3072 | 343 | GCAAAAGUAGCAAUGACCUCAUAAA | 35% |
| 15426 | 3UTR | 3083 | 344 | AAUGACCUCAUAAAAUACCUCUUCA | 40% |
| 15427 | 3UTR | 3134 | 345 | AAUUUUAUCUCAGUCUUGAAGCCAA | 55% |
| 15428 | 3UTR | 3147 | 346 | UCUUGAAGCCAAUUCAGUAGGUGCA | 52% |
| 15429 | 3UTR | 3157 | 347 | AAUUCAGUAGGUGCAUUGGAAUCAA | 71% |
| 15430 | 3UTR | 3212 | 348 | UUUCUUCUUUUAGCCAUUUUGCUAA | 38% |
| 15431 | 3UTR | 3216 | 349 | UUCUUUUAGCCAUUUUGCUAAGAGA | 40% |
| 15432 | 3UTR | 3225 | 350 | CCAUUUUGCUAAGAGACACAGUCUA | 36% |
| 15433 | 3UTR | 3278 | 351 | UUACUAGUUUUAAGAUCAGAGUUCA | 70% |

TABLE 2-continued

Inhibition of gene expression with PTGS2 ori sequences

| Target Gene Duplex ID | Gene Region | Ref Pos | SEQ ID No | PTGS2 Sense Sequence | NM_000963.2 % Expression (0.1 nM) |
|---|---|---|---|---|---|
| 15434 | 3UTR | 3313 | 352 | ACUCUGCCUAUAUUUUCUUACCUGA | 56% |
| 15435 | 3UTR | 3335 | 353 | UGAACUUUUGCAAGUUUUCAGGUAA | 64% |
| 15436 | 3UTR | 3336 | 354 | GAACUUUUGCAAGUUUUCAGGUAA | 62% |
| 15437 | 3UTR | 3351 | 355 | UUCAGGUAAACCUCAGCUCAGGACA | 62% |
| 15438 | 3UTR | 3360 | 356 | ACCUCAGCUCAGGACUGCUAUUUAA | 53% |
| 15439 | 3UTR | 3441 | 357 | CUUAUUUUAAGUGAAAAGCAGAGAA | 83% |
| 15440 | 3UTR | 3489 | 358 | UAUCUGUAACCAAGAUGGAUGCAAA | 93% |
| 15441 | 3UTR | 3662 | 359 | UUUUCCACAUCUCAUUGUCACUGAA | 36% |
| 15442 | 3UTR | 3668 | 360 | ACAUCUCAUUGUCACUGACAUUUAA | 40% |
| 15443 | 3UTR | 3735 | 361 | GUCUUAUUAGGACACUAUGGUUAUA | 40% |
| 15444 | 3UTR | 3737 | 362 | CUUAUUAGGACACUAUGGUUAUAAA | 37% |
| 15445 | 3UTR | 3738 | 363 | UUAUUAGGACACUAUGGUUAUAAAA | 38% |
| 15446 | 3UTR | 3752 | 364 | UGGUUAUAAACUGUGUUUAAGCCUA | 28% |
| 15447 | 3UTR | 3919 | 365 | AUAUUUAAGGUUGAAUGUUUGUCCA | 40% |
| 15448 | 3UTR | 3961 | 366 | CUAGCCCACAAAGAAUAUUGUCUCA | 47% |
| 15449 | 3UTR | 3981 | 367 | UCUCAUUAGCCUGAAUGUGCCAUAA | 56% |
| 15450 | 3UTR | 3994 | 368 | AAUGUGCCAUAAGACUGACCUUUUA | 52% |

TABLE 3

PTGS2 sd-rxRNA

| Duplex ID | ID | Sequence | SEQ ID NO |
|---|---|---|---|
| 17388 | 17062 | G.A.A.A.A.mC.mU.G.mC.mU.mC.A.A.Chl | 369 |
|  | 17063 | P.mU.fU.G.A.G.fC.A.G.fU.fU.fU.fU.fC*fC*fC*A*fU*A | 370 |
| 17389 | 17064 | A.mC.mC.mU.mC.mC.mC.mU.A.mU.mU.A.Chl | 371 |
|  | 17065 | P.mU.A.A.fU.A.G.G.A.G.A.G.G.fU*fU*A*G*A*G*A | 372 |
| 17390 | 17066 | mU.mC.mC.A.mC.mC.A.A.mC.mU.mU.A.A.Chl | 373 |
|  | 17068 | P.mU.fU.A.A.G.fU.fU.G.G.fU.G.G.A*fC*fU*G*fU*fC*A | 374 |
| 17391 | 17067 | G.mU.mC.mC.A.mC.mC.A.A.mC.mU.mU.A.A.Chl | 375 |
|  | 17068 | P.mU.fU.A.A.G.fU.fU.G.G.fU.G.G.A*fC*fU*G*fU*fC*A | 376 |
| 17392 | 17069 | mC.mU.mC.mC.mU.A.mU.mU.A.mU.A.mC.A.Chl | 377 |
|  | 17070 | P.mU.G.fU.A.fU.A.A.fU.A.G.G.A.G*A*G*G*fU*fU*A | 378 |
| 17393 | 17071 | G.A.mU.mC.A.mC.A.mU.mU.mU.G.A.A.Chl | 379 |
|  | 17073 | P.mU.fU.fC.A.A.A.fU.G.fU.G.A.fU.fC*fU*G*G*A*fU*G | 380 |
| 17394 | 17072 | A.G.A.mU.mC.A.mC.A.mU.mU.mU.G.A.A.Chl | 381 |
|  | 17073 | P.mU.fU.fC.A.A.A.fU.G.fU.G.A.fU.fC*fU*G*G*A*fU*G | 382 |
| 17395 | 17074 | A.A.mC.mC.mU.mC.mU.mC.mC.mU.A.mU.A.Chl | 383 |
|  | 17075 | P.mU.A.fU.A.G.G.A.G.A.G.G.fU.fU*A*G*A*G*A*A | 384 |

TABLE 3-continued

PTGS2 sd-rxRNA

| Duplex ID | ID | Sequence | SEQ ID NO |
|---|---|---|---|
| 17396 | 17076 | G.mU.mU.G.A.mC.A.mU.mC.mC.A.G.A.Chl | 385 |
| | 17077 | P.mU.fC.fU.G.G.A.fU.G.fU.fC.A.A.fC*A*fC*A*fU*A*A | 386 |
| 17397 | 17078 | mC.mC.mU.mU.mC.mC.mU.mU.mC.G.A.A.A.Chl | 387 |
| | 17079 | P.mU.fU.fU.fC.G.A.A.G.G.A.A.G.G*G*A*A*fU*G*U | 388 |
| 17398 | 17080 | A.mC.mU.mC.mC.A.A.A.mC.A.mC.A.A.Chl | 389 |
| | 17082 | P.mU.fU.G.fU.G.fU.fU.fU.G.G.A.G.fU*G*G*G*fU*fU*U | 390 |
| 17399 | 17081 | mC.A.mC.mU.mC.mC.A.A.A.mC.A.mC.A.A.Chl | 391 |
| | 17082 | P.mU.fU.G.fU.G.fU.fU.fU.G.G.A.G.fU*G*G*G*fU*fU*U | 392 |
| 17400 | 17083 | mC.A.mC.mU.mC.mC.A.A.A.mC.A.mC.A.Chl | 393 |
| | 17084 | P.mUGfUGfUfUfUGGAGfUG*G*G*fU*fU*fU*C | 394 |
| 17401 | 17085 | mC.mC.A.mC.mC.A.A.mC.mU.mU.A.mCA.Chl | 395 |
| | 17087 | P.mUGfUAAGfUfUGGfUGG*A*fC*fU*G*fU*C | 396 |
| 17402 | 17086 | mU.mC.mC.A.mC.mC.A.A.mC.mU.mU.A.mCA.Chl | 397 |
| | 17087 | P.mUGfUAAGfUfUGGfUGG*A*fC*fU*G*fU*C | 398 |
| 17403 | 17088 | A.A.mU.A.mC.mC.A.G.mU.mC.mU.mU.A.Chl | 399 |
| | 17089 | P.mU.A.A.G.A.fC.fU.G.G.fU.A.fU.fU*fU*fC*A*fU*fC*U | 400 |
| 17404 | 17090 | G.A.mC.mC.A.G.mU.A.mU.A.A.G.A.Chl | 401 |
| | 17091 | P.mU.fC.fU.fU.A.fU.A.fC.fU.G.G.fU.fC*A*A*fU*fC*C | 402 |
| 17405 | 17092 | G.mU.mC.mU.mU.mU.A.A.mU.G.A.A.Chl | 403 |
| | 17093 | P.mU.fU.fC.A.fU.fU.A.A.A.A.G.A.fC*fU*G*G*fU*A*U | 404 |
| 17406 | 17094 | A.A.mU.mU.mU.mC.A.mU.G.mU.mC.mU.A.Chl | 405 |
| | 17095 | P.mU.A.G.A.fC.A.fU.G.A.A.A.fU.fU*A*fC*fU*G*G*U | 406 |
| 17407 | 17096 | A.mU.mC.A.mC.A.mU.mU.mU.G.A.mU.A.Chl | 407 |
| | 17098 | P.mU.A.fU.fC.A.A.A.fU.G.fU.G.A.fU*fC*fU*G*G*A*U | 408 |
| 17408 | 17097 | G.A.mU.mC.A.mC.A.mU.mU.mU.G.A.mU.A.Chl | 409 |
| | 17098 | P.mU.A.fU.fC.A.A.A.fU.G.fU.G.A.fU*fC*fU*G*G*A*U | 410 |
| 17409 | 17099 | mU.mC.mC.A.G.A.mU.mC.A.mC.A.mU.A.Chl | 411 |
| | 17100 | P.mU.A.fU.G.fU.G.A.fU.fC.fU.G.G.A*fU*G*fU*fU*fC*A*A | 412 |
| 17410 | 17101 | mU.A.mC.mU.G.A.mU.A.G.G.A.G.A.Chl | 413 |
| | 17102 | P.mU.fC.fU.fC.fC.fU.A.fU.fC.A.G.fU.A*fU*fU*A*G*fC*C | 414 |
| 17411 | 17103 | G.mU.G.mC.A.A.mC.A.mC.mU.fU.G.A.Chl | 415 |
| | 17104 | P.mU.fC.A.A.G.fU.G.fU.fU.G.mC.A.fC*A*fU*A*A*fU*C | 416 |
| 17412 | 17105 | A.mC.mC.A.G.mU.A.mU.A.A.G.mU.A.Chl | 417 |
| | 17106 | P.mU.A.fC.fU.fU.A.fU.A.fC.fU.G.G.fU*fC*A*A*A*fU*C | 418 |
| 17413 | 17107 | G.A.A.G.mU.mC.mU.A.A.mU.G.A.A.Chl | 419 |
| | 17108 | P.mU.fU.fC.A.fU.fU.A.G.A.fC.mU.fU.fC*fU*A*fC*A*G*U | 420 |
| 17414 | 17109 | A.A.G.A.A.G.A.A.A.G.mU.mU.A.Chl | 421 |
| | 17110 | P.mU.A.A.fC.fU.fU.fU.fC.fU.fU.fC.fU.fU*fU*G*A*A*G*C | 422 |
| 17415 | 17111 | mU.mC.A.mC.A.mU.mU.mU.G.AmU.mU.A.Chl | 423 |
| | 17113 | P.mU.A.A.fU.fC.A.A.A.fU.G.fUG.A*fU*fC*fU*G*G*A | 424 |
| 17416 | 17112 | A.mU.mC.A.mC.A.mU.mU.mU.G.AmU.mU.A.Chl | 425 |
| | 17113 | P.mU.A.A.fU.fC.A.A.A.fU.G.fUG.A*fU*fC*fU*G*G*A | 426 |
| 17417 | 17114 | A.mC.A.mU.mU.mU.G.A.mU.mUG.A.A.Chl | 427 |
| | 17116 | P.mU.fU.fC.A.A.fU.fC.A.A.A.fUG.fU*G*A*fU*fC*fU*G | 428 |
| 17418 | 17115 | mC.A.mC.A.mU.mU.mU.G.A.mU.mUG.A.A.Chl | 429 |
| | 17116 | P.mU.fU.fC.A.A.fU.fC.A.A.A.fUG.fU*G*A*fU*fC*fU*G | 430 |
| 17419 | 17117 | A.mU.mU.mU.G.A.mU.mU.G.AmC.A.A.Chl | 431 |
| | 17119 | P.mU.fU.G.fU.fC.A.A.fU.fC.A.AA.fU*G*fU*G*A*fU*C | 432 |
| 17420 | 17118 | mC.A.mU.mU.mU.G.A.mU.mU.G.AmC.A.A.Chl | 433 |
| | 17119 | P.mU.fU.G.fU.fC.A.A.fU.fC.A.AA.fU*G*fU*G*A*fU*C | 434 |

TABLE 3-continued

PTGS2 sd-rxRNA

| Duplex ID | ID | Sequence | SEQ ID NO |
|---|---|---|---|
| 17421 | 17120 | mC.A.mU.mC.mU.G.mC.A.A.mU.A.A.A.Chl | 435 |
|  | 17122 | P.mU.fU.fU.A.fU.fU.G.fC.A.G.A.fU.G*A*G*A*C | 436 |
| 17422 | 17121 | mU.mC.A.mU.mC.mU.G.mC.A.A.mU.A.A.A.Chl | 437 |
|  | 17122 | P.mU.fU.fU.A.fU.fU.G.fC.A.G.A.fU.G*A*G*A*C | 438 |

TABLE 4

TGFB1 sd-rxRNA

Target Gene hTGFB1

| Duplex ID | Single Strand ID | sd-rxRNA sequence | SEQ ID NO |
|---|---|---|---|
| 18454 | 17491 | mC.A.mC.A.G.mC.A.mU.A.mU.A.mU.A.Chl | 439 |
|  | 17492 | P.mU.A.fU.A.fU.A.fU.G.fC.fU.G.fU.G*fU*G*fU*A*fC*U | 440 |
| 18455 | 17493 | mC.A.G.mC.A.mU.A.mU.A.mU.A.mU.A.Chl | 441 |
|  | 17494 | P.mU.A.fU.A.fU.A.fU.A.fU.G.fC.fU.G.fU*G*fU*G*fU*A | 442 |
| 18456 | 17495 | G.mU.A.mC.A.mU.mU.G.A.mC.mU.mU.A.Chl | 443 |
|  | 17497 | P.mU.A.A.G.fU.fC.A.A.fU.G.fU.A.fC*A*G*fC*fU*G*C | 444 |
| 18457 | 17496 | mU.G.mU.A.mC.A.mU.mU.G.A.mC.mU.mU.A.Chl | 445 |
|  | 17497 | P.mU.A.A.G.fU.fC.A.A.fU.G.fU.A.fC*A*G*fC*fU*G*C | 446 |
| 18458 | 17498 | A.A.mC.mU.A.mU.mU.G.mC.mU.mU.mC.A.Chl | 447 |
|  | 17500 | P.mU.G.A.A.G.fC.A.A.fU.A.G.fU.fU*G*G*fU*G*fU*C | 448 |
| 18459 | 17499 | mC.A.A.mC.mU.A.mU.mU.G.mC.mU.mU.mC.A.Chl | 449 |
|  | 17500 | P.mU.G.A.A.G.fC.A.A.fU.A.G.fU.fU*G*G*fU*G*fU*C | 450 |
| 18460 | 17501 | G.mC.A.mU.A.mU.A.mU.A.mU.G.mU.A.Chl | 451 |
|  | 17502 | P.mU.A.fC.A.fU.A.fU.A.fU.A.fU.G.fC*fU*G*fU*G*fU*G | 452 |
| 18461 | 17503 | mU.G.mU.A.mC.A.mU.mU.G.A.mC.mU.mU.A.Chl | 453 |
|  | 17505 | P.mU.A.G.fU.fC.A.A.fU.G.fU.A.fC.A*G*fC*fU*G*fC*C | 454 |
| 18462 | 17504 | mC.mU.G.mU.A.mC.A.mU.mU.G.A.mC.mU.mU.A.Chl | 455 |
|  | 17505 | P.mU.A.G.fU.fC.A.A.fU.G.fU.A.fC.A*G*fC*fU*G*fC*C | 456 |
| 18463 | 17506 | A.G.mC.A.mU.A.mU.A.mU.A.mU.G.A.Chl | 457 |
|  | 17507 | P.mU.fC.A.fU.A.fU.A.fU.A.fU.G.fC.fU*G*fU*G*fU*G*U | 458 |
| 18464 | 17508 | mC.A.G.mC.A.A.mC.A.A.mU.mU.mC.A.Chl | 459 |
|  | 17509 | P.mU.G.A.A.fU.fU.G.fU.fU.G.fC.fU.G*fU*A*fU*fU*fU*C | 460 |
| 18465 | 17510 | mC.A.mU.A.mU.A.mU.G.mU.G.mU.A.Chl | 461 |
|  | 17511 | P.mU.A.A.fC.A.fU.A.fU.A.fU.A.fU.G*fC*fU*G*fU*G*U | 462 |
| 18466 | 17512 | mU.mU.G.mC.mU.mU.mC.A.G.mC.mU.mC.A.Chl | 463 |
|  | 17514 | P.mU.G.A.G.fC.fU.G.A.A.G.fC.A.A*fU*A*G*fU*fU*G | 464 |
| 18467 | 17513 | A.mU.mU.G.mC.mU.mU.mC.A.G.mC.mU.mC.A.Chl | 465 |
|  | 17514 | P.mU.G.A.G.fC.fU.G.A.A.G.fC.A.A*fU*A*G*fU*fU*G | 466 |
| 18468 | 17515 | A.mC.A.G.mC.A.mU.A.mU.A.mU.A.A.Chl | 467 |
|  | 17516 | P.mU.fU.A.fU.A.fU.A.fU.G.fC.fU.G.fU*G*fU*G*fU*A*C | 468 |
| 18469 | 17517 | A.mU.mU.G.mC.mU.mU.mC.A.G.mC.mU.A.Chl | 469 |
|  | 17519 | P.mU.A.G.fC.fU.G.A.A.G.fC.A.A.fU*A*G*fU*fU*G*G | 470 |
| 18470 | 17518 | mU.A.mU.mU.G.mC.mU.mU.mC.A.G.mC.mU.A.Chl | 471 |
|  | 17519 | P.mU.A.G.fC.fU.G.A.A.G.fC.A.A.fU*A*G*fU*fU*G*G | 472 |
| 18471 | 17520 | mC.A.G.A.G.mU.A.mC.A.mC.A.mC.A.Chl | 473 |
|  | 17521 | P.mU.G.fU.G.fU.G.fU.A.fC.fU.fC.fU.G*C*fU*fU*G*A*A | 474 |
| 18472 | 17522 | mU.mC.A.A.G.mC.A.G.A.G.mU.A.A.Chl | 475 |
|  | 17523 | P.mU.fU.A.fC.fU.fC.fU.G.fC.fU.fU.G.A*A*fC*fU*fU*G*U | 476 |
| 18473 | 17524 | A.G.mC.A.G.A.G.mU.A.mC.A.mC.A.Chl | 477 |
|  | 17525 | P.mU.G.fU.G.fU.A.fC.fU.fC.fU.G.fC.fU*fU*G*A*A*fC*U | 478 |

TABLE 4-continued

TGFB1 sd-rxRNA

Target Gene: hTGFB1

| Duplex ID | Single Strand ID | sd-rxRNA sequence | SEQ ID NO |
|---|---|---|---|
| 18474 | 17526 | G.A.mC.A.A.G.mU.mU.mC.A.A.G.A.Chl | 479 |
| | 17527 | P.mU.fC.fU.fU.G.A.A.fC.fU.fU.G.fU.fC*A*fU*A*G*A*U | 480 |
| 18475 | 17528 | mC.U.A.mU.G.A.mC.A.A.G.mU.mU.A.Chl | 481 |
| | 17529 | P.mU.A.A.fC.fU.fU.G.fU.fC.A.fU.A.G*A*fU*fU*fU*fC*G | 482 |
| 18476 | 17530 | G.mC.A.G.A.G.mU.A.mC.A.mC.A.A.Chl | 483 |
| | 17531 | P.mU.fU.G.fU.G.fU.A.fC.fU.fC.fU.G.fC*fU*fU*G*A*A*C | 484 |
| 18477 | 17532 | mU.G.A.mC.A.A.G.mU.mU.mCA.A.A.Chl | 485 |
| | 17533 | P.mU.fU.fU.G.A.A.fC.fU.fU.GfU.fC.A*fU*A*G*A*fU*U | 486 |
| 18478 | 17534 | mU.A.mC.A.mC.A.mC.A.G.mCA.mU.A.Chl | 487 |
| | 17535 | P.mU.A.fU.G.fC.fU.G.fU.G.fUG.fU.A*fC*fU*fC*fU*G*C | 488 |
| 18479 | 17536 | A.A.mC.G.A.A.A.mU.mC.mUA.mU.A.Chl | 489 |
| | 17537 | P.mU.A.fU.A.G.A.fU.fU.fU.fCG.fU.fU*G*fU*G*G*G*U | 490 |
| 18480 | 17538 | mU.mU.G.A.mC.mU.mU.mC.mC.GmC.A.A.Chl | 491 |
| | 17539 | P.mU.fU.G.fC.G.G.A.A.G.fUfC.A.A*fU*G*fU*A*fC*A | 492 |
| 18481 | 17540 | A.mC.A.A.mC.G.A.A.A.mUmC.mU.A.Chl | 493 |
| | 17541 | P.mU.A.G.A.fU.fU.fU.fC.G.fUfU.G.fU*G*G*G*fU*fU*U | 494 |
| 18482 | 17542 | mU.mC.A.A.mC.A.mC.A.mU.mCA.G.A.Chl | 495 |
| | 17543 | P.mU.fC.fU.G.A.fU.G.fU.G.fUfU.G.A*A*G*A*A*fC*A | 496 |
| 18483 | 17544 | A.mC.A.A.G.mU.mU.mC.A.AG.mC.A.Chl | 497 |
| | 17545 | P.mU.G.fC.fU.fU.G.A.A.fC.fUfU.G.fU*fC*A*fU*A*G*A | 498 |
| 18484 | 17546 | A.mU.mC.mU.A.mU.G.A.mC.AA.G.A.Chl | 499 |
| | 17547 | P.mU.fC.fU.fU.G.fU.fC.A.fU.AG.A.fU*fU*fU*fC*G*fU*U | 500 |

Rat Targeting TGFB1

| Duplex ID | Single Strand ID | sd-rxRNA sequence | SEQ ID NO |
|---|---|---|---|
| 18715 | 18691 | G.A.A.A.mU.A.mU.A.G.mC.A.A.A-chol | 503 |
| | 18692 | P.mU.fU.fU.G.fC.fU.A.fU.A.fU.fU.fC*fU*G*G*fU*A*G | 504 |
| 18716 | 18693 | G.A.A.mC.mU.mC.mU.A.mC.mC.A.G.A-chol | 505 |
| | 18694 | P.mU.fC.fU.G.G.fU.A.G.fU.fU.fC*fU*A*fC*G*fU*G | 506 |
| 18717 | 18695 | G.mC.A.A.A.G.A.mU.A.A.mU.G.A-chol | 507 |
| | 18696 | P.mU.fC.A.fU.fU.A.fU.fC.fU.fU.fU.G.fC*fU*G*fU*fC*A*C | 508 |
| 18718 | 18697 | A.A.mC.mU.mC.mU.A.mC.mC.A.G.A.A-chol | 509 |
| | 18698 | P.mU.fU.fC.fU.G.G.fU.A.G.A.G.fU.fU*fC*fU*A*fC*G*U | 510 |
| 18719 | 18699 | A.mC.mU.mC.mU.A.mC.mC.A.G.A.A.A-chol | 511 |
| | 18700 | P.mU.fU.fU.fC.fU.G.G.fU.A.G.A.G.fU*fU*fC*fU*A*fC*G | 512 |
| 18720 | 18701 | A.mC.A.G.mC.A.A.A.G.A.mU.A.A-chol | 513 |
| | 18702 | P.mU.fU.A.fU.fC.fU.fU.fU.G.fC.fU.G.fU*fC*A*fC*A*A*G | 514 |
| 18721 | 18703 | mC.A.A.mU.mC.mU.A.mU.G.A.mC.A.A-chol | 515 |
| | 18704 | P.mU.fU.G.fU.fC.A.fU.A.G.A.fU.fU.G*fC*G*fU*fU*G*U | 516 |
| 18722 | 18705 | A.G.A.mU.mU.mC.A.A.G.mU.mC.A.A-chol | 517 |
| | 18706 | P.mU.fU.G.A.fC.fU.fU.G.A.A.fU.fC*fC*fU*G*fC*A*G | 518 |
| 18723 | 18707 | mC.mU.G.mU.G.G.A.G.mC.A.A.mC.A-chol | 519 |
| | 18708 | P.mU.G.fU.fU.G.fC.fU.fC.fC.A.fC.A.G*fU*fU*G*A*fC*U | 520 |
| 18724 | 18709 | mU.G.A.mC.A.G.mC.A.A.A.G.A.A-chol | 521 |
| | 18710 | P.mU.fU.fC.fU.fU.fU.G.fC.U.G.fU.fC.A*fC*A*A*G*A*G | 522 |
| 18725 | 18711 | A.mU.G.A.mC.A.A.A.A.mC.mC.A.A-chol | 523 |
| | 18712 | P.mU.fU.G.G.fU.fU.fU.fU.G.fU.fC.A.fU*A*G*A*A*fU*fU*G | 524 |
| 18726 | 18713 | G.A.G.A.mU.mU.mC.A.A.G.mU.mC.A-chol | 525 |
| | 18714 | P.mU.G.A.fC.fU.fU.G.A.A.fU.fC.fU.fC*fU*G*fC*A*G*G | 526 |

TABLE 5

Inhibition of gene expression with hTGFB1 ori sequences

| Target Gene Duplex ID | Gene Region | Ref Pos | SEQ ID NO | hTGFB1 Sense Sequence | % Expression 0.025 nM HeLa cells |
|---|---|---|---|---|---|
| 15732 | CDS | 954 | 527 | CGCGGGACUAUCCACCUGCAAGACA | 57.3% |
| 15733 | CDS | 956 | 528 | CGGGACUAUCCACCUGCAAGACUAA | 38.2% |
| 15734 | CDS | 957 | 529 | GGGACUAUCCACCUGCAAGACUAUA | 49.1% |
| 15735 | CDS | 961 | 530 | CUAUCCACCUGCAAGACUAUCGACA | 34.9% |
| 15736 | CDS | 962 | 531 | UAUCCACCUGCAAGACUAUCGACAA | 39.4% |
| 15737 | CDS | 964 | 532 | UCCACCUGCAAGACUAUCGACAUGA | 44.4% |
| 15738 | CDS | 965 | 533 | CCACCUGCAAGACUAUCGACAUGGA | 53.3% |
| 15739 | CDS | 966 | 534 | CACCUGCAAGACUAUCGACAUGGAA | 52.8% |
| 15740 | CDS | 967 | 535 | ACCUGCAAGACUAUCGACAUGGAGA | 46.2% |
| 15741 | CDS | 968 | 536 | CCUGCAAGACUAUCGACAUGGAGCA | 48.1% |
| 15742 | CDS | 1209 | 537 | AAUGGUGGAAACCCACAACGAAAUA | 36.7% |
| 15743 | CDS | 1210 | 538 | AUGGUGGAAACCCACAACGAAAUCA | 28.8% |
| 15744 | CDS | 1211 | 539 | UGGUGGAAACCCACAACGAAAUCUA | 23.1% |
| 15745 | CDS | 1212 | 540 | GGUGGAAACCCACAACGAAAUCUAA | 13.2% |
| 15746 | CDS | 1213 | 541 | GUGGAAACCCACAACGAAAUCUAUA | 21.1% |
| 15747 | CDS | 1214 | 542 | UGGAAACCCACAACGAAAUCUAUGA | 28.7% |
| 15748 | CDS | 1215 | 543 | GGAAACCCACAACGAAAUCUAUGAA | 32.9% |
| 15749 | CDS | 1216 | 544 | GAAACCCACAACGAAAUCUAUGACA | 41.5% |
| 15750 | CDS | 1217 | 545 | AAACCCACAACGAAAUCUAUGACAA | 29.9% |
| 15751 | CDS | 1218 | 546 | AACCCACAACGAAAUCUAUGACAAA | 16.4% |
| 15752 | CDS | 1219 | 547 | ACCCACAACGAAAUCUAUGACAAGA | 23.3% |
| 15753 | CDS | 1220 | 548 | CCCACAACGAAAUCUAUGACAAGUA | 37.5% |
| 15754 | CDS | 1221 | 549 | CCACAACGAAAUCUAUGACAAGUUA | 19.1% |
| 15755 | CDS | 1222 | 550 | CACAACGAAAUCUAUGACAAGUUCA | 14.4% |
| 15756 | CDS | 1224 | 551 | CAACGAAAUCUAUGACAAGUUCAAA | 20.1% |
| 15757 | CDS | 1225 | 552 | AACGAAAUCUAUGACAAGUUCAAGA | 18.3% |
| 15758 | CDS | 1226 | 553 | ACGAAAUCUAUGACAAGUUCAAGCA | 23.2% |
| 15759 | CDS | 1227 | 554 | CGAAAUCUAUGACAAGUUCAAGCAA | 29.0% |
| 15760 | CDS | 1228 | 555 | GAAAUCUAUGACAAGUUCAAGCAGA | 15.6% |
| 15761 | CDS | 1229 | 556 | AAAUCUAUGACAAGUUCAAGCAGAA | 32.3% |
| 15762 | CDS | 1230 | 557 | AAUCUAUGACAAGUUCAAGCAGAGA | 36.1% |
| 15763 | CDS | 1231 | 558 | AUCUAUGACAAGUUCAAGCAGAGUA | 30.6% |
| 15764 | CDS | 1232 | 559 | UCUAUGACAAGUUCAAGCAGAGUAA | 24.9% |
| 15765 | CDS | 1233 | 560 | CUAUGACAAGUUCAAGCAGAGUACA | 15.9% |
| 15766 | CDS | 1234 | 561 | UAUGACAAGUUCAAGCAGAGUACAA | 31.2% |
| 15767 | CDS | 1235 | 562 | AUGACAAGUUCAAGCAGAGUACACA | 17.2% |
| 15768 | CDS | 1236 | 563 | UGACAAGUUCAAGCAGAGUACACAA | 23.5% |

TABLE 5-continued

Inhibition of gene expression with hTGFB1 ori sequences

| Target Gene Duplex ID | Gene Region | Ref Pos | SEQ ID NO | hTGFB1 Sense Sequence | % Expression 0.025 nM HeLa cells |
|---|---|---|---|---|---|
| 15769 | CDS | 1237 | 564 | GACAAGUUCAAGCAGAGUACACACA | 24.5% |
| 15770 | CDS | 1238 | 565 | ACAAGUUCAAGCAGAGUACACACAA | 38.5% |
| 15771 | CDS | 1240 | 566 | AAGUUCAAGCAGAGUACACACAGCA | 38.7% |
| 15772 | CDS | 1241 | 567 | AGUUCAAGCAGAGUACACACAGCAA | 34.3% |
| 15773 | CDS | 1242 | 568 | GUUCAAGCAGAGUACACACAGCAUA | 20.8% |
| 15774 | CDS | 1243 | 569 | UUCAAGCAGAGUACACACAGCAUAA | 33.4% |
| 15775 | CDS | 1244 | 570 | UCAAGCAGAGUACACACAGCAUAUA | 19.6% |
| 15776 | CDS | 1245 | 571 | CAAGCAGAGUACACACAGCAUAUAA | 25.5% |
| 15777 | CDS | 1246 | 572 | AAGCAGAGUACACACAGCAUAUAUA | 12.8% |
| 15778 | CDS | 1247 | 573 | AGCAGAGUACACACAGCAUAUAUAA | 27.6% |
| 15779 | CDS | 1248 | 574 | GCAGAGUACACACAGCAUAUAUAUA | 15.9% |
| 15780 | CDS | 1249 | 575 | CAGAGUACACACAGCAUAUAUAUGA | 24.1% |
| 15781 | CDS | 1250 | 576 | AGAGUACACACAGCAUAUAUAUGUA | 22.6% |
| 15782 | CDS | 1251 | 577 | GAGUACACACAGCAUAUAUAUGUUA | 26.7% |
| 15783 | CDS | 1252 | 578 | AGUACACACAGCAUAUAUAUGUUCA | 66.6% |
| 15784 | CDS | 1254 | 579 | UACACACAGCAUAUAUAUGUUCUUA | 33.6% |
| 15785 | CDS | 1262 | 580 | GCAUAUAUAUGUUCUUCAACACAUA | 40.4% |
| 15786 | CDS | 1263 | 581 | CAUAUAUAUGUUCUUCAACACAUCA | 42.5% |
| 15787 | CDS | 1264 | 582 | AUAUAUAUGUUCUUCAACACAUCAA | 27.2% |
| 15788 | CDS | 1265 | 583 | UAUAUAUGUUCUUCAACACAUCAGA | 23.2% |
| 15789 | CDS | 1266 | 584 | AUAUAUGUUCUUCAACACAUCAGAA | 35.5% |
| 15790 | CDS | 1267 | 585 | UAUAUGUUCUUCAACACAUCAGAGA | 34.6% |
| 15791 | CDS | 1268 | 586 | AUAUGUUCUUCAACACAUCAGAGCA | 29.7% |
| 15792 | CDS | 1269 | 587 | UAUGUUCUUCAACACAUCAGAGCUA | 35.4% |
| 15793 | CDS | 1270 | 588 | AUGUUCUUCAACACAUCAGAGCUCA | 35.2% |
| 15794 | CDS | 1335 | 589 | GCUGCGUCUGCUGAGGCUCAAGUUA | 28.0% |
| 15795 | CDS | 1336 | 590 | CUGCGUCUGCUGAGGCUCAAGUUAA | 32.1% |
| 15796 | CDS | 1337 | 591 | UGCGUCUGCUGAGGCUCAAGUUAAA | 25.5% |
| 15797 | CDS | 1338 | 592 | GCGUCUGCUGAGGCUCAAGUUAAAA | 59.7% |
| 15798 | CDS | 1339 | 593 | CGUCUGCUGAGGCUCAAGUUAAAAA | 52.8% |
| 15799 | CDS | 1340 | 594 | GUCUGCUGAGGCUCAAGUUAAAAGA | 47.9% |
| 15800 | CDS | 1341 | 595 | UCUGCUGAGGCUCAAGUUAAAAGUA | 49.8% |
| 15801 | CDS | 1342 | 596 | CUGCUGAGGCUCAAGUUAAAAGUGA | 50.7% |
| 15802 | CDS | 1343 | 597 | UGCUGAGGCUCAAGUUAAAAGUGGA | 43.4% |
| 15803 | CDS | 1344 | 598 | GCUGAGGCUCAAGUUAAAAGUGGAA | 52.6% |
| 15804 | CDS | 1345 | 599 | CUGAGGCUCAAGUUAAAAGUGGAGA | 73.3% |
| 15805 | CDS | 1346 | 600 | UGAGGCUCAAGUUAAAAGUGGAGCA | 58.0% |

TABLE 5-continued

Inhibition of gene expression with hTGFB1 ori sequences

| Target Gene Duplex ID | Gene Region | Ref Pos | SEQ ID NO | hTGFB1 Sense Sequence | % Expression 0.025 nM HeLa cells |
|---|---|---|---|---|---|
| 15806 | CDS | 1347 | 601 | GAGGCUCAAGUUAAAAGUGGAGCAA | 64.9% |
| 15807 | CDS | 1348 | 602 | AGGCUCAAGUUAAAAGUGGAGCAGA | 68.1% |
| 15808 | CDS | 1349 | 603 | GGCUCAAGUUAAAAGUGGAGCAGCA | 73.8% |
| 15809 | CDS | 1350 | 604 | GCUCAAGUUAAAAGUGGAGCAGCAA | 78.8% |
| 15810 | CDS | 1351 | 605 | CUCAAGUUAAAAGUGGAGCAGCACA | 76.6% |
| 15811 | CDS | 1352 | 606 | UCAAGUUAAAAGUGGAGCAGCACGA | 72.9% |
| 15812 | CDS | 1369 | 607 | CAGCACGUGGAGCUGUACCAGAAAA | 69.8% |
| 15813 | CDS | 1370 | 608 | AGCACGUGGAGCUGUACCAGAAAUA | 69.7% |
| 15814 | CDS | 1371 | 609 | GCACGUGGAGCUGUACCAGAAAUAA | 73.3% |
| 15815 | CDS | 1372 | 610 | CACGUGGAGCUGUACCAGAAAUACA | 55.0% |
| 15816 | CDS | 1373 | 611 | ACGUGGAGCUGUACCAGAAAUACAA | 63.8% |
| 15817 | CDS | 1374 | 612 | CGUGGAGCUGUACCAGAAAUACAGA | 85.7% |
| 15818 | CDS | 1375 | 613 | GUGGAGCUGUACCAGAAAUACAGCA | 85.0% |
| 15819 | CDS | 1376 | 614 | UGGAGCUGUACCAGAAAUACAGCAA | 82.5% |
| 15820 | CDS | 1377 | 615 | GGAGCUGUACCAGAAAUACAGCAAA | 43.1% |
| 15821 | CDS | 1378 | 616 | GAGCUGUACCAGAAAUACAGCAACA | 58.5% |
| 15822 | CDS | 1379 | 617 | AGCUGUACCAGAAAUACAGCAACAA | 48.1% |
| 15823 | CDS | 1380 | 618 | GCUGUACCAGAAAUACAGCAACAAA | 48.1% |
| 15824 | CDS | 1381 | 619 | CUGUACCAGAAAUACAGCAACAAUA | 35.0% |
| 15825 | CDS | 1382 | 620 | UGUACCAGAAAUACAGCAACAAUUA | 36.4% |
| 15826 | CDS | 1383 | 621 | GUACCAGAAAUACAGCAACAAUUCA | 24.6% |
| 15827 | CDS | 1384 | 622 | UACCAGAAAUACAGCAACAAUUCCA | 33.4% |
| 15828 | CDS | 1385 | 623 | ACCAGAAAUACAGCAACAAUUCCUA | 121.5% |
| 15829 | CDS | 1386 | 624 | CCAGAAAUACAGCAACAAUUCCUGA | 62.1% |
| 15830 | CDS | 1387 | 625 | CAGAAAUACAGCAACAAUUCCUGGA | 98.3% |
| 15831 | CDS | 1390 | 626 | AAAUACAGCAACAAUUCCUGGCGAA | 36.6% |
| 15832 | CDS | 1391 | 627 | AAUACAGCAACAAUUCCUGGCGAUA | 39.5% |
| 15833 | CDS | 1392 | 628 | AUACAGCAACAAUUCCUGGCGAUAA | 40.0% |
| 15834 | CDS | 1393 | 629 | UACAGCAACAAUUCCUGGCGAUACA | 89.4% |
| 15835 | CDS | 1394 | 630 | ACAGCAACAAUUCCUGGCGAUACCA | 62.3% |
| 15836 | CDS | 1396 | 631 | AGCAACAAUUCCUGGCGAUACCUCA | 41.0% |
| 15837 | CDS | 1441 | 632 | AGCGACUCGCCAGAGUGGUUAUCUA | 31.2% |
| 15838 | CDS | 1442 | 633 | GCGACUCGCCAGAGUGGUUAUCUUA | 46.2% |
| 15839 | CDS | 1443 | 634 | CGACUCGCCAGAGUGGUUAUCUUUA | 46.8% |
| 15840 | CDS | 1444 | 635 | GACUCGCCAGAGUGGUUAUCUUUUA | 50.6% |
| 15841 | CDS | 1445 | 636 | ACUCGCCAGAGUGGUUAUCUUUUGA | 50.8% |
| 15842 | CDS | 1446 | 637 | CUCGCCAGAGUGGUUAUCUUUUGAA | 71.8% |

TABLE 5-continued

Inhibition of gene expression with hTGFB1 ori sequences

| Target Gene Duplex ID | Gene Region | Ref Pos | SEQ ID NO | hTGFB1 Sense Sequence | % Expression 0.025 nM HeLa cells |
|---|---|---|---|---|---|
| 15843 | CDS | 1447 | 638 | UCGCCAGAGUGGUUAUCUUUUGAUA | 43.7% |
| 15844 | CDS | 1448 | 639 | CGCCAGAGUGGUUAUCUUUUGAUGA | 42.1% |
| 15845 | CDS | 1449 | 640 | GCCAGAGUGGUUAUCUUUUGAUGUA | 31.0% |
| 15846 | CDS | 1450 | 641 | CCAGAGUGGUUAUCUUUUGAUGUCA | 46.0% |
| 15847 | CDS | 1451 | 642 | CAGAGUGGUUAUCUUUUGAUGUCAA | 40.2% |
| 15848 | CDS | 1452 | 643 | AGAGUGGUUAUCUUUUGAUGUCACA | 38.5% |
| 15849 | CDS | 1453 | 644 | GAGUGGUUAUCUUUUGAUGUCACCA | 67.4% |
| 15850 | CDS | 1454 | 645 | AGUGGUUAUCUUUUGAUGUCACCGA | 57.4% |
| 15851 | CDS | 1455 | 646 | GUGGUUAUCUUUUGAUGUCACCGGA | 40.6% |
| 15852 | CDS | 1456 | 647 | UGGUUAUCUUUUGAUGUCACCGGAA | 70.5% |
| 15853 | CDS | 1457 | 648 | GGUUAUCUUUUGAUGUCACCGGAGA | 82.8% |
| 15854 | CDS | 1458 | 649 | GUUAUCUUUUGAUGUCACCGGAGUA | 74.8% |
| 15855 | CDS | 1459 | 650 | UUAUCUUUUGAUGUCACCGGAGUUA | 86.8% |
| 15856 | CDS | 1460 | 651 | UAUCUUUUGAUGUCACCGGAGUUGA | 76.5% |
| 15857 | CDS | 1551 | 652 | CAGCAGGGAUAACACACUGCAAGUA | 70.5% |
| 15858 | CDS | 1552 | 653 | AGCAGGGAUAACACACUGCAAGUGA | 60.5% |
| 15859 | CDS | 1553 | 654 | GCAGGGAUAACACACUGCAAGUGGA | 43.5% |
| 15860 | CDS | 1554 | 655 | CAGGGAUAACACACUGCAAGUGGAA | 56.3% |
| 15861 | CDS | 1555 | 656 | AGGGAUAACACACUGCAAGUGGACA | 63.9% |
| 15862 | CDS | 1556 | 657 | GGGAUAACACACUGCAAGUGGACAA | 66.9% |
| 15863 | CDS | 1558 | 658 | GAUAACACACUGCAAGUGGACAUCA | 62.2% |
| 15864 | CDS | 1559 | 659 | AUAACACACUGCAAGUGGACAUCAA | 40.5% |
| 15865 | CDS | 1560 | 660 | UAACACACUGCAAGUGGACAUCAAA | 57.9% |
| 15866 | CDS | 1610 | 661 | ACCUGGCCACCAUUCAUGGCAUGAA | 69.4% |
| 15867 | CDS | 1611 | 662 | CCUGGCCACCAUUCAUGGCAUGAAA | 49.1% |
| 15868 | CDS | 1612 | 663 | CUGGCCACCAUUCAUGGCAUGAACA | 31.9% |
| 15869 | CDS | 1705 | 664 | CGAGCCCUGGACACCAACUAUUGCA | 56.4% |
| 15870 | CDS | 1706 | 665 | GAGCCCUGGACACCAACUAUUGCUA | 42.6% |
| 15871 | CDS | 1707 | 666 | AGCCCUGGACACCAACUAUUGCUUA | 29.8% |
| 15872 | CDS | 1708 | 667 | GCCCUGGACACCAACUAUUGCUUCA | 19.8% |
| 15873 | CDS | 1709 | 668 | CCCUGGACACCAACUAUUGCUUCAA | 37.7% |
| 15874 | CDS | 1710 | 669 | CCUGGACACCAACUAUUGCUUCAGA | 44.0% |
| 15875 | CDS | 1711 | 670 | CUGGACACCAACUAUUGCUUCAGCA | 35.8% |
| 15876 | CDS | 1712 | 671 | UGGACACCAACUAUUGCUUCAGCUA | 31.5% |
| 15877 | CDS | 1713 | 672 | GGACACCAACUAUUGCUUCAGCUCA | 27.3% |
| 15878 | CDS | 1714 | 673 | GACACCAACUAUUGCUUCAGCUCCA | 44.7% |
| 15879 | CDS | 1715 | 674 | ACACCAACUAUUGCUUCAGCUCCAA | 44.9% |

TABLE 5-continued

Inhibition of gene expression with hTGFB1 ori sequences

| Duplex ID | Gene Region | Ref Pos | SEQ ID NO | hTGFB1 Sense Sequence | % Expression 0.025 nM HeLa cells |
|---|---|---|---|---|---|
| 15880 | CDS | 1754 | 675 | GCGUGCGGCAGCUGUACAUUGACUA | 23.9% |
| 15881 | CDS | 1755 | 676 | CGUGCGGCAGCUGUACAUUGACUUA | 18.3% |
| 15882 | CDS | 1756 | 677 | GUGCGGCAGCUGUACAUUGACUUCA | 41.2% |
| 15883 | CDS | 1757 | 678 | UGCGGCAGCUGUACAUUGACUUCCA | 26.4% |
| 15884 | CDS | 1759 | 679 | CGGCAGCUGUACAUUGACUUCCGCA | 28.0% |
| 15885 | CDS | 1760 | 680 | GGCAGCUGUACAUUGACUUCCGCAA | 22.8% |
| 15886 | CDS | 1761 | 681 | GCAGCUGUACAUUGACUUCCGCAAA | 34.1% |
| 15887 | CDS | 1762 | 682 | CAGCUGUACAUUGACUUCCGCAAGA | 36.3% |
| 15888 | CDS | 1763 | 683 | AGCUGUACAUUGACUUCCGCAAGGA | 84.1% |
| 15889 | CDS | 1849 | 684 | UGCCCCUACAUUUGGAGCCUGGACA | 93.0% |
| 15890 | CDS | 1889 | 685 | UCCUGGCCCUGUACAACCAGCAUAA | 51.7% |
| 15891 | CDS | 1890 | 686 | CCUGGCCCUGUACAACCAGCAUAAA | 71.9% |
| 15892 | CDS | 1891 | 687 | CUGGCCCUGUACAACCAGCAUAACA | 36.1% |
| 15893 | CDS | 1997 | 688 | AGGUGGAGCAGCUGUCCAACAUGAA | 60.9% |
| 15894 | 3UTR | 2115 | 689 | CAUGGGGGCUGUAUUUAAGGACACA | 57.2% |
| 15895 | 3UTR | 2155 | 690 | CCUGGGGCCCCAUUAAAGAUGGAGA | 86.0% |
| 15896 | 3UTR | 2156 | 691 | CUGGGGCCCCAUUAAAGAUGGAGAA | 73.3% |
| 15897 | 3UTR | 2157 | 692 | UGGGGCCCCAUUAAAGAUGGAGAGA | 68.8% |
| 15898 | 3UTR | 2158 | 693 | GGGGCCCCAUUAAAGAUGGAGAGAA | 65.8% |
| 15899 | 3UTR | 2159 | 694 | GGGCCCCAUUAAAGAUGGAGAGAGA | 42.7% |
| 15900 | 3UTR | 2160 | 695 | GGCCCCAUUAAAGAUGGAGAGAGGA | 34.4% |
| 15901 | 3UTR | 2161 | 696 | GCCCCAUUAAAGAUGGAGAGAGGAA | 56.0% |
| 15902 | 3UTR | 2162 | 697 | CCCCAUUAAAGAUGGAGAGAGGACA | 74.9% |
| 15903 | 3UTR | 2163 | 698 | CCCAUUAAAGAUGGAGAGAGGACUA | 79.6% |
| 15904 | 3UTR | 2180 | 699 | GAGGACUGCGGAUCUCUGUGUCAUA | 98.3% |
| 15905 | 3UTR | 2275 | 700 | CUCCUGCCUGUCUGCACUAUUCCUA | 100.2% |
| 15906 | 3UTR | 2276 | 701 | UCCUGCCUGUCUGCACUAUUCCUUA | 103.8% |
| 15907 | 3UTR | 2277 | 702 | CCUGCCUGUCUGCACUAUUCCUUUA | 110.4% |
| 15908 | 3UTR | 2278 | 703 | CUGCCUGUCUGCACUAUUCCUUUGA | 105.2% |
| 15909 | 3UTR | 2279 | 704 | UGCCUGUCUGCACUAUUCCUUUGCA | 118.8% |
| 15910 | 3UTR | 2325 | 705 | CAGUGGGGAACACUACUGUAGUUAA | 112.2% |
| 15911 | 3UTR | 2326 | 706 | AGUGGGGAACACUACUGUAGUUAGA | 107.7% |
| 15912 | 3UTR | 2327 | 707 | GUGGGGAACACUACUGUAGUUAGAA | 108.6% |
| 15913 | 3UTR | 2328 | 708 | UGGGGAACACUACUGUAGUUAGAUA | N/A |

TABLE 6

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15451 | 5UTR/CDS | 651 | 98% | UUUUAAAAAAUGCACUACUGUGUGC | 709 |
| 15452 | CDS | 654 | 102.2% | UAAAAAAUGCACUACUGUGUGCUGA | 710 |
| 15453 | CDS | 730 | 83.7% | GCAGCACACUCGAUAUGGACCAGUU | 711 |
| 15454 | CDS | 732 | 80.3% | AGCACACUCGAUAUGGACCAGUUCA | 712 |
| 15455 | CDS | 733 | 79.6% | GCACACUCGAUAUGGACCAGUUCAU | 713 |
| 15456 | CDS | 734 | 89.1% | CACACUCGAUAUGGACCAGUUCAUG | 714 |
| 15457 | CDS | 735 | 87.8% | ACACUCGAUAUGGACCAGUUCAUGC | 715 |
| 15458 | CDS | 736 | 95.3% | CACUCGAUAUGGACCAGUUCAUGCG | 716 |
| 15459 | CDS | 847 | 103.8% | UCCCCCCGGAGGUGAUUUCCAUCUA | 717 |
| 15460 | CDS | 848 | 83.6% | CCCCCCGGAGGUGAUUUCCAUCUAC | 718 |
| 15461 | CDS | 851 | 72.2% | CCCGGAGGUGAUUUCCAUCUACAAC | 719 |
| 15462 | CDS | 853 | 85.8% | CGGAGGUGAUUUCCAUCUACAACAG | 720 |
| 15463 | CDS | 855 | 67.1% | GAGGUGAUUUCCAUCUACAACAGCA | 721 |
| 15464 | CDS | 952 | 68.9% | ACUACGCCAAGGAGGUUUACAAAAU | 722 |
| 15465 | CDS | 963 | 81.1% | GAGGUUUACAAAAUAGACAUGCCGC | 723 |
| 15466 | CDS | 1107 | 82.1% | UUCUACAGACCCUACUUCAGAAUUG | 724 |
| 15467 | CDS | 1108 | 99.1% | UCUACAGACCCUACUUCAGAAUUGU | 725 |
| 15468 | CDS | 1109 | 95.1% | CUACAGACCCUACUUCAGAAUUGUU | 726 |
| 15469 | CDS | 1129 | 90.4% | UUGUUCGAUUUGACGUCUCAGCAAU | 727 |
| 15470 | CDS | 1130 | 76.7% | UGUUCGAUUUGACGUCUCAGCAAUG | 728 |
| 15471 | CDS | 1131 | 79.7% | GUUCGAUUUGACGUCUCAGCAAUGG | 729 |
| 15472 | CDS | 1132 | 87.5% | UUCGAUUUGACGUCUCAGCAAUGGA | 730 |
| 15473 | CDS | 1144 | 66.9% | UCUCAGCAAUGGAGAAGAAUGCUUC | 731 |
| 15474 | CDS | 1145 | 76.6% | CUCAGCAAUGGAGAAGAAUGCUUCC | 732 |
| 15475 | CDS | 1147 | 88.9% | CAGCAAUGGAGAAGAAUGCUUCCAA | 733 |
| 15476 | CDS | 1162 | 84.5% | AUGCUUCCAAUUUGGUGAAAGCAGA | 734 |
| 15477 | CDS | 1163 | 89.2% | UGCUUCCAAUUUGGUGAAAGCAGAG | 735 |
| 15478 | CDS | 1165 | 86.6% | CUUCCAAUUUGGUGAAAGCAGAGUU | 736 |
| 15479 | CDS | 1177 | 61.2% | UGAAAGCAGAGUUCAGAGUCUUUCG | 737 |
| 15480 | CDS | 1185 | 92.6% | GAGUUCAGAGUCUUUCGUUUGCAGA | 738 |
| 15481 | CDS | 1219 | 99.6% | CCAGAGUGCCUGAACAACGGAUUGA | 739 |
| 15482 | CDS | 1224 | 94.0% | GUGCCUGAACAACGGAUUGAGCUAU | 740 |
| 15483 | CDS | 1225 | 88.1% | UGCCUGAACAACGGAUUGAGCUAUA | 741 |
| 15484 | CDS | 1228 | 59.3% | CUGAACAACGGAUUGAGCUAUAUCA | 742 |
| 15485 | CDS | 1229 | 77.5% | UGAACAACGGAUUGAGCUAUAUCAG | 743 |
| 15486 | CDS | 1230 | 61.5% | GAACAACGGAUUGAGCUAUAUCAGA | 744 |
| 15487 | CDS | 1233 | 84.5% | CAACGGAUUGAGCUAUAUCAGAUUC | 745 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15488 | CDS | 1238 | 87.7% | GAUUGAGCUAUAUCAGAUUCUCAAG | 746 |
| 15489 | CDS | 1239 | 78.7% | AUUGAGCUAUAUCAGAUUCUCAAGU | 747 |
| 15490 | CDS | 1240 | 94.1% | UUGAGCUAUAUCAGAUUCUCAAGUC | 748 |
| 15491 | CDS | 1247 | 92.6% | AUAUCAGAUUCUCAAGUCCAAAGAU | 749 |
| 15492 | CDS | 1256 | 94.3% | UCUCAAGUCCAAAGAUUUAACAUCU | 750 |
| 15493 | CDS | 1259 | 99.1% | CAAGUCCAAAGAUUUAACAUCUCCA | 751 |
| 15494 | CDS | 1286 | 87.4% | CCAGCGCUACAUCGACAGCAAAGUU | 752 |
| 15495 | CDS | 1288 | 84.5% | AGCGCUACAUCGACAGCAAAGUUGU | 753 |
| 15496 | CDS | 1289 | 60.1% | GCGCUACAUCGACAGCAAAGUUGUG | 754 |
| 15497 | CDS | 1292 | 78.8% | CUACAUCGACAGCAAAGUUGUGAAA | 755 |
| 15498 | CDS | 1331 | 80.1% | CGAAUGGCUCUCCUUCGAUGUAACU | 756 |
| 15499 | CDS | 1353 | 62.4% | ACUGAUGCUGUUCAUGAAUGGCUUC | 757 |
| 15500 | CDS | 1361 | 74.3% | UGUUCAUGAAUGGCUUCACCAUAAA | 758 |
| 15501 | CDS | 1362 | 75.1% | GUUCAUGAAUGGCUUCACCAUAAAG | 759 |
| 15502 | CDS | 1363 | 87.2% | UUCAUGAAUGGCUUCACCAUAAAGA | 760 |
| 15503 | CDS | 1364 | 70.4% | UCAUGAAUGGCUUCACCAUAAAGAC | 761 |
| 15504 | CDS | 1365 | 100.7% | CAUGAAUGGCUUCACCAUAAAGACA | 762 |
| 15505 | CDS | 1368 | 100.1% | GAAUGGCUUCACCAUAAAGACAGGA | 763 |
| 15506 | CDS | 1398 | 92.0% | GGAUUUAAAAUAAGCUUACACUGUC | 764 |
| 15507 | CDS | 1399 | 83.2% | GAUUUAAAAUAAGCUUACACUGUCC | 765 |
| 15508 | CDS | 1415 | 85.6% | ACACUGUCCCUGCUGCACUUUUGUA | 766 |
| 15509 | CDS | 1418 | 97.4% | CUGUCCCUGCUGCACUUUUGUACCA | 767 |
| 15510 | CDS | 1420 | 59.1% | GUCCCUGCUGCACUUUUGUACCAUC | 768 |
| 15511 | CDS | 1421 | 73.7% | UCCCUGCUGCACUUUUGUACCAUCU | 769 |
| 15512 | CDS | 1422 | 79.5% | CCCUGCUGCACUUUUGUACCAUCUA | 770 |
| 15513 | CDS | 1451 | 62.7% | UUACAUCAUCCCAAAUAAAAGUGAA | 771 |
| 15514 | CDS | 1452 | 76.0% | UACAUCAUCCCAAAUAAAAGUGAAG | 772 |
| 15515 | CDS | 1470 | 44.7% | AGUGAAGAACUAGAAGCAAGAUUUG | 773 |
| 15516 | CDS | 1472 | 75.6% | UGAAGAACUAGAAGCAAGAUUUGCA | 774 |
| 15517 | CDS | 1474 | 96.8% | AAGAACUAGAAGCAAGAUUUGCAGG | 775 |
| 15518 | CDS | 1475 | 94.3% | AGAACUAGAAGCAAGAUUUGCAGGU | 776 |
| 15519 | CDS | 1476 | 63.3% | GAACUAGAAGCAAGAUUUGCAGGUA | 777 |
| 15520 | CDS | 1480 | 65.9% | UAGAAGCAAGAUUUGCAGGUAUUGA | 778 |
| 15521 | CDS | 1481 | 59.6% | AGAAGCAAGAUUUGCAGGUAUUGAU | 779 |
| 15522 | CDS | 1482 | 56.0% | GAAGCAAGAUUUGCAGGUAUUGAUG | 780 |
| 15523 | CDS | 1483 | 69.2% | AAGCAAGAUUUGCAGGUAUUGAUGG | 781 |
| 15524 | CDS | 1484 | 64.5% | AGCAAGAUUUGCAGGUAUUGAUGGC | 782 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15525 | CDS | 1485 | 92.0% | GCAAGAUUUGCAGGUAUUGAUGGCA | 783 |
| 15526 | CDS | 1486 | 101.7% | CAAGAUUUGCAGGUAUUGAUGGCAC | 784 |
| 15527 | CDS | 1496 | 103.3% | AGGUAUUGAUGGCACCUCCACAUAU | 785 |
| 15528 | CDS | 1503 | 102.3% | GAUGGCACCUCCACAUAUACCAGUG | 786 |
| 15529 | CDS | 1506 | 86.6% | GGCACCUCCACAUAUACCAGUGGUG | 787 |
| 15530 | CDS | 1510 | 79.9% | CCUCCACAUAUACCAGUGGUGAUCA | 788 |
| 15531 | CDS | 1511 | 44.9% | CUCCACAUAUACCAGUGGUGAUCAG | 789 |
| 15532 | CDS | 1512 | 57.3% | UCCACAUAUACCAGUGGUGAUCAGA | 790 |
| 15533 | CDS | 1517 | 64.9% | AUAUACCAGUGGUGAUCAGAAAACU | 791 |
| 15534 | CDS | 1518 | 90.8% | UAUACCAGUGGUGAUCAGAAAACUA | 792 |
| 15535 | CDS | 1520 | 47.1% | UACCAGUGGUGAUCAGAAAACUAUA | 793 |
| 15536 | CDS | 1526 | 55.7% | UGGUGAUCAGAAAACUAUAAAGUCC | 794 |
| 15537 | CDS | 1527 | 89.6% | GGUGAUCAGAAAACUAUAAAGUCCA | 795 |
| 15538 | CDS | 1529 | 92.4% | UGAUCAGAAAACUAUAAAGUCCACU | 796 |
| 15539 | CDS | 1531 | 87.2% | AUCAGAAAACUAUAAAGUCCACUAG | 797 |
| 15540 | CDS | 1532 | 93.4% | UCAGAAAACUAUAAAGUCCACUAGG | 798 |
| 15541 | CDS | 1575 | 78.4% | ACCCCACAUCUCCUGCUAAUGUUAU | 799 |
| 15542 | CDS | 1576 | 84.6% | CCCCACAUCUCCUGCUAAUGUUAUU | 800 |
| 15543 | CDS | 1579 | 95.9% | CACAUCUCCUGCUAAUGUUAUUGCC | 801 |
| 15544 | CDS | 1591 | 89.6% | UAAUGUUAUUGCCCUCCUACAGACU | 802 |
| 15545 | CDS | 1592 | 85.0% | AAUGUUAUUGCCCUCCUACAGACUU | 803 |
| 15546 | CDS | 1598 | 51.2% | AUUGCCCUCCUACAGACUUGAGUCA | 804 |
| 15547 | CDS | 1650 | 39.4% | GCUUUGGAUGCGGCCUAUUGCUUUA | 805 |
| 15548 | CDS | 1652 | 82.3% | UUUGGAUGCGGCCUAUUGCUUUAGA | 806 |
| 15549 | CDS | 1653 | 86.1% | UUGGAUGCGGCCUAUUGCUUUAGAA | 807 |
| 15550 | CDS | 1655 | 80.0% | GGAUGCGGCCUAUUGCUUUAGAAAU | 808 |
| 15551 | CDS | 1657 | 72.3% | AUGCGGCCUAUUGCUUUAGAAAUGU | 809 |
| 15552 | CDS | 1658 | 72.2% | UGCGGCCUAUUGCUUUAGAAAUGUG | 810 |
| 15553 | CDS | 1659 | 57.8% | GCGGCCUAUUGCUUUAGAAAUGUGC | 811 |
| 15554 | CDS | 1660 | 83.4% | CGGCCUAUUGCUUUAGAAAUGUGCA | 812 |
| 15555 | CDS | 1662 | 79.3% | GCCUAUUGCUUUAGAAAUGUGCAGG | 813 |
| 15556 | CDS | 1663 | 86.3% | CCUAUUGCUUUAGAAAUGUGCAGGA | 814 |
| 15557 | CDS | 1664 | 84.8% | CUAUUGCUUUAGAAAUGUGCAGGAU | 815 |
| 15558 | CDS | 1665 | 71.1% | UAUUGCUUUAGAAAUGUGCAGGAUA | 816 |
| 15559 | CDS | 1666 | 61.8% | AUUGCUUUAGAAAUGUGCAGGAUAA | 817 |
| 15560 | CDS | 1667 | 84.9% | UUGCUUUAGAAAUGUGCAGGAUAAU | 818 |
| 15561 | CDS | 1668 | 82.8% | UGCUUUAGAAAUGUGCAGGAUAAUU | 819 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15562 | CDS | 1670 | 69.8% | CUUUAGAAAUGUGCAGGAUAAUUGC | 820 |
| 15563 | CDS | 1671 | 90.2% | UUUAGAAAUGUGCAGGAUAAUUGCU | 821 |
| 15564 | CDS | 1672 | 68.6% | UUAGAAAUGUGCAGGAUAAUUGCUG | 822 |
| 15565 | CDS | 1678 | 74.2% | AUGUGCAGGAUAAUUGCUGCCUACG | 823 |
| 15566 | CDS | 1761 | 58.6% | GGGUACAAUGCCAACUUCUGUGCUG | 824 |
| 15567 | CDS | 1767 | 86.3% | AAUGCCAACUUCUGUGCUGGAGCAU | 825 |
| 15568 | CDS | 1782 | 83.7% | GCUGGAGCAUGCCCGUAUUUAUGGA | 826 |
| 15569 | CDS | 1783 | 86.9% | CUGGAGCAUGCCCGUAUUUAUGGAG | 827 |
| 15570 | CDS | 1786 | 90.5% | GAGCAUGCCCGUAUUUAUGGAGUUC | 828 |
| 15571 | CDS | 1787 | 91.1% | AGCAUGCCCGUAUUUAUGGAGUUCA | 829 |
| 15572 | CDS | 1788 | 68.0% | GCAUGCCCGUAUUUAUGGAGUUCAG | 830 |
| 15573 | CDS | 1789 | 75.7% | CAUGCCCGUAUUUAUGGAGUUCAGA | 831 |
| 15574 | CDS | 1796 | 88.9% | GUAUUUAUGGAGUUCAGACACUCAG | 832 |
| 15575 | CDS | 1800 | 52.5% | UUAUGGAGUUCAGACACUCAGCACA | 833 |
| 15576 | CDS | 1907 | 90.8% | AACCAUUCUCUACUACAUUGGCAAA | 834 |
| 15577 | CDS | 1924 | 70.2% | UUGGCAAAACACCCAAGAUUGAACA | 835 |
| 15578 | CDS | 1925 | 77.5% | UGGCAAAACACCCAAGAUUGAACAG | 836 |
| 15579 | CDS/3UTR | 1973 | 91.1% | UUGCAAAUGCAGCUAAAAUUCUUGG | 837 |
| 15580 | 3UTR | 2020 | 70.1% | CAAUGAUGAUAAUGAUGAUGAC | 838 |
| 15581 | 3UTR | 2022 | 43.3% | AUGAUGAUAAUGAUGAUGACGA | 839 |
| 15582 | 3UTR | 2023 | 60.3% | UGAUGAUAAUGAUGAUGACGAC | 840 |
| 15583 | 3UTR | 2025 | 75.4% | AUGAUAAUGAUGAUGACGACGA | 841 |
| 15584 | 3UTR | 2026 | 40.8% | UGAUAAUGAUGAUGACGACGAC | 842 |
| 15585 | 3UTR | 2028 | 51.8% | AUAAUGAUGAUGACGACGACAA | 843 |
| 15586 | 3UTR | 2029 | 59.1% | UAAUGAUGAUGACGACGACAAC | 844 |
| 15587 | 3UTR | 2031 | 51.3% | AUGAUGAUGACGACGACAACGA | 845 |
| 15588 | 3UTR | 2032 | 32.7% | UGAUGAUGACGACGACAACGAU | 846 |
| 15589 | 3UTR | 2034 | 33.8% | AUGAUGAUGACGACGACAACGAUGA | 847 |
| 15590 | 3UTR | 2035 | 57.0% | UGAUGAUGACGACGACAACGAUGAU | 848 |
| 15591 | 3UTR | 2039 | 40.5% | GAUGACGACGACAACGAUGAUGCUU | 849 |
| 15592 | 3UTR | 2045 | 56.8% | GACGACAACGAUGAUGCUUGUAACA | 850 |
| 15593 | 3UTR | 2046 | 28.5% | ACGACAACGAUGAUGCUUGUAACAA | 851 |
| 15594 | 3UTR | 2065 | 44.7% | UAACAAGAAAACAUAAGAGAGCCUU | 852 |
| 15595 | 3UTR | 2066 | 58.3% | AACAAGAAAACAUAAGAGAGCCUUG | 853 |
| 15596 | 3UTR | 2067 | 62.9% | ACAAGAAAACAUAAGAGAGCCUUGG | 854 |
| 15597 | 3UTR | 2072 | 38.1% | AAAACAUAAGAGAGCCUUGGUUCAU | 855 |
| 15598 | 3UTR | 2073 | 44.6% | AAACAUAAGAGAGCCUUGGUUCAUC | 856 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15599 | 3UTR | 2079 | 53.6% | AAGAGAGCCUUGGUUCAUCAGUGUUU | 857 |
| 15600 | 3UTR | 2081 | 33.2% | GAGAGCCUUGGUUCAUCAGUGUUAA | 858 |
| 15601 | 3UTR | 2083 | 28.2% | GAGCCUUGGUUCAUCAGUGUUAAAA | 859 |
| 15602 | 3UTR | 2110 | 46.5% | UUUUUGAAAAGGCGGUACUAGUUCA | 860 |
| 15603 | 3UTR | 2116 | 56.1% | AAAAGGCGGUACUAGUUCAGACACU | 861 |
| 15604 | 3UTR | 2117 | 60.9% | AAAGGCGGUACUAGUUCAGACACUU | 862 |
| 15605 | 3UTR | 2136 | 76.8% | ACACUUUGGAAGUUUGUGUUCUGUU | 863 |
| 15606 | 3UTR | 2137 | 29.5% | CACUUUGGAAGUUUGUGUUCUGUUU | 864 |
| 15607 | 3UTR | 2140 | 62.6% | UUUGGAAGUUUGUGUUCUGUUUGUU | 865 |
| 15608 | 3UTR | 2145 | 50.7% | AAGUUUGUGUUCUGUUUGUUAAAAC | 866 |
| 15609 | 3UTR | 2147 | 62.9% | GUUUGUGUUCUGUUUGUUAAAACUG | 867 |
| 15610 | 3UTR | 2148 | 59.7% | UUUGUGUUCUGUUUGUUAAAACUGG | 868 |
| 15611 | 3UTR | 2149 | 50.3% | UUGUGUUCUGUUUGUUAAAACUGGC | 869 |
| 15612 | 3UTR | 2150 | 49.8% | UGUGUUCUGUUUGUUAAAACUGGCA | 870 |
| 15613 | 3UTR | 2152 | 55.2% | UGUUCUGUUUGUUAAAACUGGCAUC | 871 |
| 15614 | 3UTR | 2153 | 82.2% | GUUCUGUUUGUUAAAACUGGCAUCU | 872 |
| 15615 | 3UTR | 2154 | 70.0% | UUCUGUUUGUUAAAACUGGCAUCUG | 873 |
| 15616 | 3UTR | 2155 | 45.5% | UCUGUUUGUUAAAACUGGCAUCUGA | 874 |
| 15617 | 3UTR | 2156 | 54.9% | CUGUUUGUUAAAACUGGCAUCUGAC | 875 |
| 15618 | 3UTR | 2189 | 40.4% | AGUUGAAGGCCUUAUUCUACAUUUC | 876 |
| 15619 | 3UTR | 2190 | 34.1% | GUUGAAGGCCUUAUUCUACAUUUCA | 877 |
| 15620 | 3UTR | 2207 | 91.3% | ACAUUUCACCUACUUUGUAAGUGAG | 878 |
| 15621 | 3UTR | 2265 | 60.9% | AAUAAACACUGGAAGAAUUUAUUAG | 879 |
| 15622 | 3UTR | 2267 | 36.4% | UAAACACUGGAAGAAUUUAUUAGUG | 880 |
| 15623 | 3UTR | 2295 | 40.6% | AUUAUGUGAACAACGACAACAACAA | 881 |
| 15624 | 3UTR | 2296 | 33.6% | UUAUGUGAACAACGACAACAACAAC | 882 |
| 15625 | 3UTR | 2297 | 32.7% | UAUGUGAACAACGACAACAACAACA | 883 |
| 15626 | 3UTR | 2298 | 40.8% | AUGUGAACAACGACAACAACAACAA | 884 |
| 15627 | 3UTR | 2299 | 38.5% | UGUGAACAACGACAACAACAACAAC | 885 |
| 15628 | 3UTR | 2301 | 84.2% | UGAACAACGACAACAACAACAACAA | 886 |
| 15629 | 3UTR | 2302 | 43.2% | GAACAACGACAACAACAACAACAAC | 887 |
| 15630 | 3UTR | 2304 | 57.8% | ACAACGACAACAACAACAACAACAA | 888 |
| 15631 | 3UTR | 2305 | 44.3% | CAACGACAACAACAACAACAACAAC | 889 |
| 15632 | 3UTR | 2308 | 38.7% | CGACAACAACAACAACAACAACAAA | 890 |
| 15633 | 3UTR | 2309 | 37.4% | GACAACAACAACAACAACAACAAAC | 891 |
| 15634 | 3UTR | 2314 | 73.5% | CAACAACAACAACAAACAGGAA | 892 |
| 15635 | 3UTR | 2315 | 54.2% | AACAACAACAACAAACAGGAAA | 893 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15636 | 3UTR | 2389 | 30.7% | CUUGAUUUUCUGUAUUGCUAUGCA | 894 |
| 15637 | 3UTR | 2435 | 16.0% | ACUCUUAGAGUUAACAGUGAGUUAU | 895 |
| 15638 | 3UTR | 2445 | 18.4% | UUAACAGUGAGUUAUUAUUGUGUG | 896 |
| 15639 | 3UTR | 2471 | 36.3% | UACUAUAUAAUGAACGUUUCAUUGC | 897 |
| 15640 | 3UTR | 2472 | 73.3% | ACUAUAUAAUGAACGUUUCAUUGCC | 898 |
| 15641 | 3UTR | 2484 | 63.4% | ACGUUUCAUUGCCCUUGGAAAAUAA | 899 |
| 15642 | 3UTR | 2488 | 65.4% | UUCAUUGCCCUUGGAAAAUAAAACA | 900 |
| 15643 | 3UTR | 2493 | 39.3% | UGCCCUUGGAAAAUAAAACAGGUGU | 901 |
| 15644 | 3UTR | 2519 | 66.7% | UAAAGUGGAGACCAAAUACUUUGCC | 902 |
| 15645 | 3UTR | 2520 | 40.1% | AAAGUGGAGACCAAAUACUUUGCCA | 903 |
| 15646 | 3UTR | 2526 | 40.9% | GAGACCAAAUACUUUGCCAGAAACU | 904 |
| 15647 | 3UTR | 2527 | 41.5% | AGACCAAAUACUUUGCCAGAAACUC | 905 |
| 15648 | 3UTR | 2528 | 47.6% | GACCAAAUACUUUGCCAGAAACUCA | 906 |
| 15649 | 3UTR | 2529 | 47.6% | ACCAAAUACUUUGCCAGAAACUCAU | 907 |
| 15650 | 3UTR | 2530 | 31.9% | CCAAAUACUUUGCCAGAAACUCAUG | 908 |
| 15651 | 3UTR | 2531 | 29.0% | CAAAUACUUUGCCAGAAACUCAUGG | 909 |
| 15652 | 3UTR | 2537 | 78.0% | CUUUGCCAGAAACUCAUGGAUGGCU | 910 |
| 15653 | 3UTR | 2538 | 52.4% | UUUGCCAGAAACUCAUGGAUGGCUU | 911 |
| 15654 | 3UTR | 2540 | 59.7% | UGCCAGAAACUCAUGGAUGGCUUAA | 912 |
| 15655 | 3UTR | 2541 | 45.1% | GCCAGAAACUCAUGGAUGGCUUAAG | 913 |
| 15656 | 3UTR | 2542 | 42.1% | CCAGAAACUCAUGGAUGGCUUAAGG | 914 |
| 15657 | 3UTR | 2543 | 76.9% | CAGAAACUCAUGGAUGGCUUAAGGA | 915 |
| 15658 | 3UTR | 2544 | 29.0% | AGAAACUCAUGGAUGGCUUAAGGAA | 916 |
| 15659 | 3UTR | 2547 | 45.2% | AACUCAUGGAUGGCUUAAGGAACUU | 917 |
| 15660 | 3UTR | 2560 | 38.4% | CUUAAGGAACUUGAACUCAAACGAG | 918 |
| 15661 | 3UTR | 2561 | 33.3% | UUAAGGAACUUGAACUCAAACGAGC | 919 |
| 15662 | 3UTR | 2562 | 31.9% | UAAGGAACUUGAACUCAAACGAGCC | 920 |
| 15663 | 3UTR | 2563 | 44.5% | AAGGAACUUGAACUCAAACGAGCCA | 921 |
| 15664 | 3UTR | 2564 | 90.1% | AGGAACUUGAACUCAAACGAGCCAG | 922 |
| 15665 | 3UTR | 2566 | 64.4% | GAACUUGAACUCAAACGAGCCAGAA | 923 |
| 15666 | 3UTR | 2623 | 32.5% | AAGUGAGUUAUUAUAUGACCGAGAA | 924 |
| 15667 | 3UTR | 2681 | 34.0% | UGUUAUGUAUCAGCUGCCUAAGGAA | 925 |
| 15668 | 3UTR | 2791 | 59.0% | UUUAAUUGUAAAUGGUUCUUUGUCA | 926 |
| 15669 | 3UTR | 2792 | 56.3% | UUAAUUGUAAAUGGUUCUUUGUCAG | 927 |
| 15670 | 3UTR | 2793 | 46.8% | UAAUUGUAAAUGGUUCUUUGUCAGU | 928 |
| 15671 | 3UTR | 2795 | 53.2% | AUUGUAAAUGGUUCUUUGUCAGUUU | 929 |
| 15672 | 3UTR | 2798 | 33.1% | GUAAAUGGUUCUUUGUCAGUUUAGU | 930 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15673 | 3UTR | 2809 | 32.8% | UUUGUCAGUUUAGUAAACCAGUGAA | 931 |
| 15674 | 3UTR | 2813 | 40.9% | UCAGUUUAGUAAACCAGUGAAAUGU | 932 |
| 15675 | 3UTR | 2816 | 38.1% | GUUUAGUAAACCAGUGAAAUGUUGA | 933 |
| 15676 | 3UTR | 2840 | 59.4% | AAAUGUUUUGACAUGUACUGGUCAA | 934 |
| 15677 | 3UTR | 2957 | 77.9% | UGGAUAUAGAAGCCAGCAUAAUUGA | 935 |
| 15678 | 3UTR | 2958 | 74.1% | GGAUAUAGAAGCCAGCAUAAUUGAA | 936 |
| 15679 | 3UTR | 2959 | 52.4% | GAUAUAGAAGCCAGCAUAAUUGAAA | 937 |
| 15680 | 3UTR | 2963 | 49.9% | UAGAAGCCAGCAUAAUUGAAAACAC | 938 |
| 15681 | 3UTR | 2964 | 45.3% | AGAAGCCAGCAUAAUUGAAAACACA | 939 |
| 15682 | 3UTR | 2966 | 45.5% | AAGCCAGCAUAAUUGAAAACACAUC | 940 |
| 15683 | 3UTR | 3137 | 60.5% | ACAAAUGUAUGUUUCUUUUAGCUGG | 941 |
| 15684 | 3UTR | 3138 | 63.6% | CAAAUGUAUGUUUCUUUUAGCUGGC | 942 |
| 15685 | 3UTR | 3142 | 58.4% | UGUAUGUUUCUUUUAGCUGGCCAGU | 943 |
| 15686 | 3UTR | 3144 | 56.3% | UAUGUUUCUUUUAGCUGGCCAGUAC | 944 |
| 15687 | 3UTR | 3145 | 52.1% | AUGUUUCUUUUAGCUGGCCAGUACU | 945 |
| 15688 | 3UTR | 3147 | 74.6% | GUUUCUUUUAGCUGGCCAGUACUUU | 946 |
| 15689 | 3UTR | 3150 | 70.4% | UCUUUUAGCUGGCCAGUACUUUUGA | 947 |
| 15690 | 3UTR | 3154 | 61.7% | UUAGCUGGCCAGUACUUUUGAGUAA | 948 |
| 15691 | 3UTR | 3156 | 52.3% | AGCUGGCCAGUACUUUUGAGUAAAG | 949 |
| 15692 | 3UTR | 3157 | 72.2% | GCUGGCCAGUACUUUUGAGUAAAGC | 950 |
| 15693 | 3UTR | 3158 | 62.4% | CUGGCCAGUACUUUUGAGUAAAGCC | 951 |
| 15694 | 3UTR | 3180 | 49.0% | GCCCCUAUAGUUUGACUUGCACUAC | 952 |
| 15695 | 3UTR | 3182 | 43.9% | CCCUAUAGUUUGACUUGCACUACAA | 953 |
| 15696 | 3UTR | 3183 | 35.2% | CCUAUAGUUUGACUUGCACUACAAA | 954 |
| 15697 | 3UTR | 3184 | 38.1% | CUAUAGUUUGACUUGCACUACAAAU | 955 |
| 15698 | 3UTR | 3185 | 73.3% | UAUAGUUUGACUUGCACUACAAAUG | 956 |
| 15699 | 3UTR | 3256 | 86.3% | UUCAUUAUUAUGACAUAAGCUACCU | 957 |
| 15700 | 3UTR | 3258 | 61.6% | CAUUAUUAUGACAUAAGCUACCUGG | 958 |
| 15701 | 3UTR | 3342 | 66.0% | UUCAUCUUCCAAGCAUCAUUACUAA | 959 |
| 15702 | 3UTR | 3346 | 67.3% | UCUUCCAAGCAUCAUUACUAACCAA | 960 |
| 15703 | 3UTR | 3358 | 63.6% | CAUUACUAACCAAGUCAGACGUUAA | 961 |
| 15704 | 3UTR | 3396 | 71.8% | UAGGAAAAGGAGGAAUGUUAUAGAU | 962 |
| 15705 | 3UTR | 3550 | 69.1% | UUGUUAUUACAAAGAGGACACUUCA | 963 |
| 15706 | 3UTR | 3657 | 72.3% | GGGGAAAAAAGUCCAGGUCAGCAUA | 964 |
| 15707 | 3UTR | 3671 | 79.7% | AGGUCAGCAUAAGUCAUUUUGUGUA | 965 |
| 15708 | 3UTR | 3779 | 57.5% | UUUCUUUCCUCUGAGUGAGAGUUAU | 966 |
| 15709 | 3UTR | 3783 | 62.6% | UUUCCUCUGAGUGAGAGUUAUCUAU | 967 |

TABLE 6-continued

Inhibition of gene expression with hTGFB2 ori sequences

| Oligo id | Gene Region | Ref Pos | % Expression A549 0.1 nM | 25-mer Sense Strand (position 25 of SS, replaced with A) | SEQ ID NO |
|---|---|---|---|---|---|
| 15710 | 3UTR | 3932 | 61.3% | UAAAAAUUAAUAGGCAAAGCAAUGG | 968 |
| 15711 | 3UTR | 3934 | 44.3% | AAAAUUAAUAGGCAAAGCAAUGGAA | 969 |
| 15712 | 3UTR | 4034 | 68.7% | UUUUUUGGAAUUUCCUGACCAUUAA | 970 |
| 15713 | 3UTR | 4058 | 50.6% | AUUAAAGAAUUGGAUUUGCAAGUUU | 971 |
| 15714 | 3UTR | 4120 | 69.8% | UAAACAGCCCUUGUGUUGGAUGUAA | 972 |
| 15715 | 3UTR | 4147 | 39.5% | CAAUCCCAGAUUUGAGUGUGUGUUG | 973 |
| 15716 | 3UTR | 4148 | 62.2% | AAUCCCAGAUUUGAGUGUGUGUUGA | 974 |
| 15717 | 3UTR | 4152 | 34.2% | CCAGAUUUGAGUGUGUGUUGAUUAU | 975 |
| 15718 | 3UTR | 4273 | 38.0% | GUCUUUCCUCAUGAAUGCACUGAUA | 976 |
| 15719 | 3UTR | 4460 | 48.5% | UAUUUUGUGUUAAUCAGCAGUACA | 977 |
| 15720 | 3UTR | 4482 | 37.1% | ACAAUUUGAUCGUUGGCAUGGUUAA | 978 |
| 15721 | 3UTR | 4580 | 60.1% | GUUUUGUGGUGCUCUAGUGGUAAA | 979 |
| 15722 | 3UTR | 4583 | 50.6% | UUUGUGGUGCUCUAGUGGUAAAUAA | 980 |
| 15723 | 3UTR | 4584 | 42.1% | UUGUGGUGCUCUAGUGGUAAAUAAA | 981 |
| 15724 | 3UTR | 4642 | 91.3% | UCAGUACCAUCAUCGAGUCUAGAAA | 982 |
| 15725 | 3UTR | 4737 | 90.4% | UUCUCCCUUAAGGACAGUCACUUCA | 983 |
| 15726 | 3UTR | 4751 | 94.6% | CAGUCACUUCAGAAGUCAUGCUUUA | 984 |
| 15727 | 3UTR | 4753 | 87.2% | GUCACUUCAGAAGUCAUGCUUUAAA | 985 |
| 15728 | 3UTR | 4858 | 70.2% | GUAAUUGUUUGAGAUUUAGUUUCCA | 986 |
| 15729 | 3UTR | 4963 | 81.2% | CGCCAGGGCCAAAAGAACUGGUCUA | 987 |
| 15730 | 3UTR | 5177 | 81.4% | CCAGACUCCUCAAACGAGUUGCCAA | 988 |

TABLE 7 hTGFB2 sd-rxRNA

| Target Gene Duplex ID | hTGFB2 Single Strand ID | sd-rxRNA sequences | SEQ ID NO |
|---|---|---|---|
| 18570 | 17560 | mU.A.mU.mU.mU.A.mU.mU.G.mU.G.mU.A.Chl | 989 |
|  | 17562 | P.mU.A.fC.A.fC.A.A.fU.A.A.A.fU.A*A*fC*fU*fC*A*C | 990 |
| 18571 | 17561 | mU.mU.A.mU.mU.A.mU.mU.G.mU.G.mU.A.Chl | 991 |
|  | 17562 | P.mU.A.fC.A.fC.A.A.fU.A.A.A.fU.A*A*fC*fU*fC*A*C | 992 |
| 18572 | 17563 | A.mU.mC.A.G.mU.G.mU.mU.A.A.A.A.Chl | 993 |
|  | 17565 | P.mU.fU.fU.fU.A.A.fC.A.fC.fU.G.A.fU*G*A*A*fC*fC*A | 994 |
| 18573 | 17564 | mC.A.mU.mC.A.G.mU.G.mU.mU.A.A.A.A.Chl | 995 |
|  | 17565 | P.mU.fU.fU.fU.A.A.fC.A.fC.fU.G.A.fU*G*A*A*fC*fC*A | 996 |
| 18574 | 17566 | A.mU.G.G.mC.mU.mU.A.A.G.G.A.A.Chl | 997 |
|  | 17568 | P.mU.fU.fC.fC.fU.fU.A.A.G.fC.fC.A.fU*fC*fC*A*fU*G*A | 998 |
| 18575 | 17567 | G.A.mU.G.G.mC.mU.mU.A.A.G.G.A.A.Chl | 999 |
|  | 17568 | P.mU.fU.fC.fC.fU.fU.A.A.G.fC.fC.A.fU*fC*fC*A*fU*G*A | 1000 |
| 18576 | 17569 | mU.mU.G.mU.G.mU.mU.mC.G.mU.mU.A.Chl | 1001 |
|  | 17571 | P.mU.A.A.fC.A.G.A.A.fC.A.fC.A.A*A*fC*fU*fU*fC*C | 1002 |

TABLE 7-continued hTGFB2 sd-rxRNA

| Target Gene Duplex ID | hTGFB2 Single Strand ID | sd-rxRNA sequences | SEQ ID NO |
|---|---|---|---|
| 18577 | 17570 | mU.mU.mU.G.mU.G.mU.mU.mC.mU.G.mU.mU.A.Chl | 1003 |
|  | 17571 | P.mU.A.A.fC.A.G.A.A.fC.A.fC.A.A*A*fC*fU*fU*fC*C | 1004 |
| 18578 | 17572 | A.A.A.mU.A.mC.mU.mU.mU.G.mC.mC.A.Chl | 1005 |
|  | 17574 | P.mU.G.G.fC.A.A.A.G.fU.A.fU.fU.fU.fU*G*G*fU*fC*U*C | 1006 |
| 18579 | 17573 | mC.A.A.A.mU.A.mC.mU.mU.mU.G.mC.mC.A.Chl | 1007 |
|  | 17574 | P.mU.G.G.fC.A.A.A.G.fU.A.fU.fU.fU*G*G*fU*fC*fU*C | 1008 |
| 18580 | 17575 | mC.mU.mU.G.mC.A.mC.mU.A.mC.A.A.A.Chl | 1009 |
|  | 17577 | P.mU.fU.fU.G.fU.A.G.fU.G.fC.A.A.G*fU*fC*A*A*C | 1010 |
| 18581 | 17576 | A.mC.mU.mU.G.mC.A.mC.mU.A.mC.A.A.A.Chl | 1011 |
|  | 17577 | P.mU.fU.fU.G.fU.A.G.fU.G.fC.A.A.G*fU*fC*A*A*C | 1012 |
| 18582 | 17578 | G.A.A.mU.mU.mU.A.mU.mU.A.G.mU.A.Chl | 1013 |
|  | 17580 | P.mU.A.fC.fU.A.A.fU.A.A.A.fU.fU.fC*fU*fU*fC*fC*A*G | 1014 |
| 18583 | 17579 | A.G.A.A.mU.mU.mU.A.mU.mU.A.G.mU.A.Chl | 1015 |
|  | 17580 | P.mU.A.fC.fU.A.A.fU.A.A.A.fU.fU.fC*fU*fU*fC*fC*A*G | 1016 |
| 18584 | 17581 | mU.mU.G.mC.A.mC.mU.A.mC.A.A.A.A.Chl | 1017 |
|  | 17583 | P.mU.fU.fU.fU.G.fU.A.G.fU.G.fC.A.A*G*fU*fC*A*A*A | 1018 |
| 18585 | 17582 | mC.mU.mU.G.mC.A.mC.mU.A.mC.A.A.A.A.Chl | 1019 |
|  | 17583 | P.mU.fU.fU.fU.G.fU.A.G.fU.G.fC.A.A*G*fU*fC*A*A*A | 1020 |
| 18586 | 17584 | A.mU.A.A.A.mC.A.G.G.mU.G.A.Chl | 1021 |
|  | 17586 | P.mU.fC.A.fC.fC.fU.G.fU.fU.fU.A.fU*fU*fU*fU*fC*fC*A | 1022 |
| 18587 | 17585 | A.A.mU.A.A.A.mC.A.G.G.mU.G.A.Chl | 1023 |
|  | 17586 | P.mU.fC.A.fC.fC.fU.G.fU.fU.fU.A.fU*fU*fU*fU*fC*fC*A | 1024 |
| 18588 | 17587 | G.A.mC.A.A.mC.A.A.mC.A.A.mC.A.Chl | 1025 |
|  | 17588 | P.mU.G.fU.fU.G.fU.fU.G.fU.fU.G.fU.fC*G*fU*fU*G*fU*U | 1026 |
| 18589 | 17589 | A.mU.G.mC.mU.mU.G.mU.A.mC.A.A.Chl | 1027 |
|  | 17590 | P.mU.fU.G.fU.fU.A.fC.A.A.G.fC.A.fU*fC*A*fU*fC*G*U | 1028 |
| 18590 | 17591 | mC.A.G.A.A.mC.mU.mC.A.mU.G.A.Chl | 1029 |
|  | 17592 | P.mU.fC.A.fU.G.A.G.fU.fU.fC.fU.G*G*fC*A*A*G | 1030 |
| 18591 | 17593 | G.mU.A.mU.mU.G.mC.mU.A.mU.G.mC.A.Chl | 1031 |
|  | 17594 | P.mU.G.fC.A.fU.A.G.fC.A.A.fU.A.fC*A*G*A*A*A | 1032 |
| 18592 | 17595 | mC.mC.A.G.A.A.A.mC.mU.mC.A.mU.A.Chl | 1033 |
|  | 17596 | P.mU.A.fU.G.A.G.fU.fU.fU.fC.fU.G.G*fC*A*A*A*G*U | 1034 |
| 18593 | 17597 | A.mC.mU.mC.A.A.A.mC.G.A.G.mC.A.Chl | 1035 |
|  | 17598 | P.mU.G.fC.fU.fC.G.fU.fU.fU.G.A.G.fU*fU*fC*A*A*G*U | 1036 |
| 18594 | 17599 | A.mU.A.mU.G.A.mC.mC.G.A.G.A.A.Chl | 1037 |
|  | 17600 | P.mU.fU.fC.fU.fC.G.G.fU.fC.A.fU.A.fU*A*A*fU*A*A*C | 1038 |
| 18595 | 17601 | mC.G.A.mC.G.A.mC.A.A.mC.G.A.A.Chl | 1039 |
|  | 17602 | P.mU.fU.fC.G.fU.fU.G.fU.fC.G.fU.fC.G*fU*fC*A*fU*fC*A | 1040 |
| 18596 | 17603 | G.mU.A.A.A.mC.mC.A.G.mU.G.A.A.Chl | 1041 |
|  | 17604 | P.mU.fU.fC.A.fC.fU.G.G.fU.fU.A.fC*fU*A*A*A*fC*U | 1042 |
| 18597 | 17605 | mU.mU.G.mU.mC.A.G.mU.mU.mU.A.G.A.Chl | 1043 |
|  | 17606 | P.mU.fC.fU.A.A.A.fC.fU.G.A.fC.A*A*G*A*A*fC*C | 1044 |
| 18598 | 17607 | mU.mC.A.mU.mC.A.G.mU.G.mU.mU.A.A.Chl | 1045 |
|  | 17608 | P.mU.fU.A.A.fC.A.fC.fU.G.A.fU.G.A*A*fC*fC*A*A*G | 1046 |
| 18599 | 17609 | A.A.mC.mU.mC.A.A.A.mC.G.A.G.A.Chl | 1047 |
|  | 17610 | P.mU.fC.fU.fC.G.fU.fU.fU.G.A.G.fU.fU*fC*A*A*G*fU*U | 1048 |
| 18600 | 17611 | mC.G.A.mC.A.A.mC.A.A.mC.A.A.A.Chl | 1049 |
|  | 17612 | P.mU.fU.fU.G.fU.fU.G.fU.fU.G.fU.fC.G*fU*fU*G*fU*fU*C | 1050 |
| 18601 | 17613 | A.mC.G.A.mC.A.A.mC.G.A.mU.G.A.Chl | 1051 |
|  | 17614 | P.mU.fC.A.fU.fC.G.fU.fU.G.fU.fC.G.fU*fC*G*fU*fC*A*U | 1052 |

TABLE 7-continued hTGFB2 sd-rxRNA

| Target Gene Duplex ID | hTGFB2 Single Strand ID | sd-rxRNA sequences | SEQ ID NO |
|---|---|---|---|
| 18602 | 17615 | G.mC.mU.G.mC.mC.mU.A.A.G.G.A.A.Chl | 1053 |
| | 17616 | P.mU.fU.fC.fC.fU.fU.A.G.G.fC.A.G.fC*fU*G*A*fU*A*C | 1054 |
| 18603 | 17617 | A.mU.mU.mC.mA.mC.A.mU.mU.mU.mC.A.Chl | 1055 |
| | 17618 | P.mU.G.A.A.A.fU.G.fU.A.G.A.A.fU*A*A*G*G*fC*C | 1056 |
| 18604 | 17619 | G.mU.G.mU.G.mU.mU.G.A.mU.mU.A.A.Chl | 1057 |
| | 17620 | P.mU.fU.A.A.fU.fC.A.A.fC.A.fC.A.fC*A*fC*fU*fC*A*A | 1058 |
| Rat TGFB2 sd-rxRNA | | | |
| 18678 | 18604 | mC.G.G.mU.G.A.mC.A.A.mU.G.A.A-chol | 1061 |
| | 18605 | mU.fU.fC.A.fU.fU.G.fU.fC.A.fC.G*fU*G*A*fU*fU*U | 1062 |
| 18679 | 18606 | mU.mU.G.mU.mC.mU.mC.G.G.mU.A.mU.A-chol | 1063 |
| | 18607 | mU.A.fU.A.fC.fC.G.A.G.fC.A.A*A*G*G*G*A*A | 1064 |
| 18680 | 18608 | G.A.G.mU.mU.G.mU.A.mU.G.mU.A.A-chol | 1065 |
| | 18609 | mU.fU.A.fC.A.fU.A.fC.A.A.fC.fU.fC*fC*A*fC*fU*G*A | 1066 |
| 18681 | 18610 | A.mU.mU.mU.G.mU.mU.A.G.mU.G.mU.A-chol | 1067 |
| | 18611 | mU.A.fC.A.fC.fU.A.A.fC.A.A.A.fU*fU*fC*fU*fU*fC*C | 1068 |
| 18682 | 18612 | G.mC.A.A.G.mU.mC.mU.G.A.G.A.A-chol | 1069 |
| | 18613 | mU.fU.fC.fU.fC.A.G.A.fC.fU.fU.G.fC*fU*fC*A*G*fU*U | 1070 |
| 18683 | 18614 | A.A.A.mU.mC.A.mC.G.G.mU.G.A.A-chol | 1071 |
| | 18615 | mU.fU.fC.A.fC.fC.G.fU.G.A.fU.fU.fU*fU*fC*A*A*fU*fC*C | 1072 |
| 18684 | 18616 | A.A.A.mU.G.mC.A.G.mC.mU.A.A.A-chol | 1073 |
| | 18617 | mU.fU.fU.A.G.fC.fU.G.fC.A.fU.fU.fU*A*fC*A*A*G*A | 1074 |
| 18685 | 18618 | mC.mU.mU.G.G.A.A.A.A.mU.A.A.A-chol | 1075 |
| | 18619 | mU.fU.fU.A.fU.fU.fU.fU.fC.fC.A.A.G*G*G*fC*A*A*U | 1076 |
| 18686 | 18620 | mC.mC.mU.mU.mU.G.A.A.mU.A.A.A.A-chol | 1077 |
| | 18621 | mU.fU.fU.fU.A.fU.fU.fC.A.A.A.G.G*fU*A*fC*fU*G*G | 1078 |
| 18687 | 18622 | A.A.mC.A.mC.A.mC.mU.G.mC.A.A.A-chol | 1079 |
| | 18623 | mU.fU.fU.G.fC.A.G.fU.G.fU.G.fU.fU*fU*fU*fC*A*fU*C | 1080 |
| 18688 | 18624 | A.A.A.A.mC.A.mC.A.mC.mU.G.mC.A-chol | 1081 |
| | 18625 | mU.G.fC.A.G.fU.G.fU.G.fU.fU.fU.fU*fC*A*fU*fC*A*U | 1082 |
| 18689 | 18626 | G.A.A.G.mC.mC.mU.G.mU.mU.A.A-chol | 1083 |
| | 18627 | mU.fU.A.A.fC.A.G.G.fC.fC.fU.fU.fC*fU*G*G*A*fC*A | 1084 |
| 18690 | 18628 | mU.A.mU.mU.G.mC.mU.mC.mU.G.mC.A.A-chol | 1085 |
| | 18629 | mU.fU.G.fC.A.G.A.G.fC.A.A.fU.A*fC*A*G*A*G*G | 1086 |

TABLE 8 hSPP1 sd-rxRNA

| Target Gene Duplex ID | hSPP1 Single Strand ID | sd-rxRNA sequence | SEQ ID NO |
|---|---|---|---|
| 18538 | 17430 | G.A.mU.G.A.A.mU.mC.mU.G.A.mU.A.Chl | 1087 |
| | 17432 | P.mU.A.fU.fC.A.G.A.fU.fU.fC.A.fU.fC*A*G*A*A*fU*G | 1088 |
| 18539 | 17431 | mU.G.A.mU.G.A.A.mU.mC.mU.G.A.mU.A.Chl | 1089 |
| | 17432 | P.mU.A.fU.fC.A.G.A.fU.fU.fC.A.fU.fC*A*G*A*A*fU*G | 1090 |
| 18540 | 17433 | A.mU.mU.mU.G.mC.mU.mU.mU.mU.G.mC.A.Chl | 1091 |
| | 17435 | P.mU.G.fC.A.A.A.A.G.fC.A.A.A.fU*fC*A*fC*fU*G*fC | 1092 |
| 18541 | 17434 | G.A.mU.mU.mU.G.mC.mU.mU.mU.mU.G.mC.A.Chl | 1093 |
| | 17435 | P.mU.G.fC.A.A.A.A.G.fC.A.A.A.fU*fC*A*fC*fU*G*fC | 1094 |
| 18542 | 17436 | G.mU.G.A.mU.mU.mU.G.mC.mU.mU.mU.mU.AChl | 1095 |
| | 17438 | P.mU.A.A.A.G.fC.A.A.A.fU.fC.A.fC*fU*G*fC*A*A*fU | 1096 |

TABLE 8-continued hSPP1 sd-rxRNA

| Target Gene Duplex ID | hSPP1 Single Strand ID | sd-rxRNA sequence | SEQ ID NO |
|---|---|---|---|
| 18543 | 17437 | A.G.mU.G.A.mU.mU.mU.G.mC.mU.mU.mU.A.Chl | 1097 |
|  | 17438 | P.mU.A.A.A.G.fC.A.A.A.fU.fC.A.fC*fU*G*fC*A*fU | 1098 |
| 18544 | 17439 | A.A.mU.mU.mU.mC.G.mU.A.mU.mU.mU.A.Chl | 1099 |
|  | 17441 | P.mU.A.A.A.fU.A.fC.G.A.A.A.fU.fU*fU*fC*A*G*G*fU | 1100 |
| 18545 | 17440 | A.A.A.mU.mU.mU.mC.G.mU.A.mU.mU.mU.A.Chl | 1101 |
|  | 17441 | P.mU.A.A.A.fU.A.fC.G.A.A.A.fU.fU*fU*fC*A*G*G*fU | 1102 |
| 18546 | 17442 | mC.A.mC.A.G.mC.mC.A.mU.G.A.A.A.Chl | 1103 |
|  | 17444 | P.mU.fU.fU.C.A.fU.G.G.fC.fU.G.fU.G*A*A*A*fU*fU*fC | 1104 |
| 18547 | 17443 | mU.mC.A.mC.A.G.mC.mC.A.mU.G.A.A.A.Chl | 1105 |
|  | 17444 | P.mU.fU.fU.C.A.fU.G.G.fC.fU.G.fU.G*A*A*A*fU*fU*fC | 1106 |
| 18548 | 17445 | G.A.mU.mU.mU.G.mC.mU.mU.mU.mU.G.A.Chl | 1107 |
|  | 17447 | P.mU.fC.A.A.A.A.G.fC.A.A.A.fU.fC*A*fC*fU*G*fC*A | 1108 |
| 18549 | 17446 | mU.G.A.mU.mU.mU.G.mC.mU.mU.mU.mU.G.A.Chl | 1109 |
|  | 17447 | P.mU.fC.A.A.A.A.G.fC.A.A.A.fU.fC*A*fC*fU*G*fC*A | 1110 |
| 18550 | 17448 | mU.mU.G.mC.mU.mU.mU.mU.G.mC.mC.mU.A.Chl | 1111 |
|  | 17450 | P.mU.A.G.G.fC.A.A.A.A.G.fC.A.A*A*fU*fC*A*fC*U | 1112 |
| 18551 | 17449 | mU.mU.mU.G.mC.mU.mU.mU.mU.mU.G.mC.mC.mU.A.Chl | 1113 |
|  | 17450 | P.mU.A.G.G.fC.A.A.A.A.G.fC.A.A*A*fU*fC*A*fC*U | 1114 |
| 18552 | 17451 | mU.mU.mU.mC.mU.mC.A.G.mU.mU.mU.A.A.Chl | 1115 |
|  | 17452 | P.mU.fU.A.A.A.fC.fU.G.A.G.A.A.A*G*A*A*G*fC*A | 1116 |
| 18553 | 17453 | mU.mG.G.mC.A.mU.mU.mU.A.G.mU.mC.A.Chl | 1117 |
|  | 17454 | P.mU.G.A.fC.fU.A.A.A.fU.G.fC.A.A*A*G*fU*G*A*G | 1118 |
| 18554 | 17455 | A.mC.mU.mU.G.mC.A.mU.mU.mU.A.Chl | 1119 |
|  | 17456 | P.mU.fU.A.A.A.fU.G.fC.A.A.A.G.fU*G*A*G*A*A*A | 1120 |
| 18555 | 17457 | A.mU.mU.mU.A.G.mU.mC.A.A.A.A.A.Chl | 1121 |
|  | 17458 | P.mU.fU.fU.fU.fU.G.A.fC.fU.A.A.A.fU*G*fC*A*A*G | 1122 |
| 18556 | 17459 | mU.mU.mC.mU.mU.mU.mC.mU.mC.A.G.mU.A.Chl | 1123 |
|  | 17460 | P.mU.A.fC.fU.G.A.G.A.A.A.G.A.A*G*fC*A*fU*fU*fU | 1124 |
| 18557 | 17461 | mU.mC.mU.mU.mU.mC.mU.mC.A.G.mU.mU.A.Chl | 1125 |
|  | 17462 | P.mU.A.A.fC.fU.G.A.G.A.A.A.G.A*A*G*fC*A*fU*fU | 1126 |
| 18558 | 17463 | G.A.A.A.G.A.G.A.A.mC.A.mU.A.Chl | 1127 |
|  | 17464 | P.mU.A.fU.G.fU.fU.fC.fU.fC.fU.fU.fU.fC*A*fU*fU*fU*fU*G | 1128 |
| 18559 | 17465 | mC.mU.mU.mU.G.mC.A.mU.mU.mU.A.G.A.Chl | 1129 |
|  | 17466 | P.mU.fC.fU.A.A.A.fU.G.fC.A.A.A.G*fU*G*A*G*A*A | 1130 |
| 18560 | 17467 | mU.mU.mU.G.mC.A.mU.mU.mU.A.G.mU.A.Chl | 1131 |
|  | 17468 | P.mU.A.fC.fU.A.A.A.fU.G.fC.A.A.A*G*fU*G*A*G*A | 1132 |
| 18561 | 17469 | mC.mU.mC.A.mC.mU.mU.mU.G.mC.A.mU.A.Chl | 1133 |
|  | 17470 | P.mU.A.fU.G.fC.A.A.A.G.fU.G.A.G*A*A*A*fU*fU*G | 1134 |
| 18562 | 17471 | mU.mU.mC.mU.mC.A.mC.mU.mU.mU.G.mC.A.Chl | 1135 |
|  | 17472 | P.mU.G.fC.A.A.A.G.fU.G.A.G.A.A*A*fU*fU*G*fU*A | 1136 |
| 18563 | 17473 | mC.A.mC.mU.mC.mC.A.G.mU.mU.G.mU.A.Chl | 1137 |
|  | 17474 | P.mU.A.fC.A.A.fC.fU.G.G.A.G.fU.G*A*A*A*A*fC*U | 1138 |
| 18564 | 17475 | A.A.mU.G.A.A.A.G.A.G.A.A.A.Chl | 1139 |
|  | 17476 | P.mU.fU.fU.fC.fU.fC.fU.fU.fU.fC.A.fU.fU*fU*fU*G*fC*fU*A | 1140 |
| 18565 | 17477 | mU.G.mC.A.G.mU.G.A.mU.mU.mU.mG.A.Chl | 1141 |
|  | 17478 | P.mU.fC.A.A.A.fU.fC.A.fC.fU.G.fC.A*A*fU*fU*fC*fU*C | 1142 |
| 18566 | 17479 | mU.G.A.A.A.G.A.G.A.A.mC.A.A.Chl | 1143 |
|  | 17480 | P.mU.fU.G.fU.fU.fC.fU.fC.fU.fU.fC.A*fU*fU*fU*fU*G*C | 1144 |
| 18567 | 17481 | A.mC.mC.mU.G.A.A.A.mU.mU.mU.mC.A.Chl | 1145 |
|  | 17482 | P.mU.G.A.A.A.fU.fU.fU.fC.A.G.G.fU*G*fU*fU*fU*A*U | 1146 |

TABLE 8-continued hSPP1 sd-rxRNA

| Target Gene Duplex ID | Single Strand ID | hSPP1 sd-rxRNA sequence | SEQ ID NO |
|---|---|---|---|
| 18568 | 17483 | G.A.A.mU.mU.G.mC.A.G.mU.G.A.A.Chl | 1147 |
|  | 17484 | P.mU.fU.fC.A.fC.fU.G.fC.A.A.fU.fU.fC*fU*fC*A*fU*G*G | 1148 |
| 18569 | 17485 | G.G.mC.U.G.A.U.U.mC.U.G.G.A.Chl | 1149 |
|  | 17486 | P.mU.fC.fC.A.G.A.A.fU.fC.A.G.fC.fC*fU*G*fU*fU*A | 1150 |
| Rat Targeting SPP1 |  |  |  |
| 18662 | 18630 | G.mU.mU.mC.G.mU.mU.G.mU.mU.mC.A-chol | 1151 |
|  | 18631 | P.mU.G.A.A.A.fC.A.A.fC.G.A.A.fC*fU*A*A*G*fC*U | 1152 |
| 18663 | 18632 | G.A.A.A.G.A.A.A.mU.A.G.A.A-chol | 1153 |
|  | 18633 | P.mU.fU.fC.fU.A.fU.fU.fU.fC.fU.fU.fU.fC*fU*fC*fC*A*fC*A | 1154 |
| 18664 | 18634 | G.mU.G.G.A.G.A.A.A.G.A.A.A-chol | 1155 |
|  | 18635 | P.mU.fU.fU.fC.fU.fU.fU.fC.fU.fC.fC.A.fC*A*fU*A*fC*A*U | 1156 |
| 18665 | 18636 | mC.mU.G.mU.G.mU.mC.A.mC.mU.A.mU.A-chol | 1157 |
|  | 18637 | P.mU.A.fU.A.G.fU.G.A.fC.A.fC.A.G*A*fC*fU*A*fU*U | 1158 |
| 18666 | 18638 | G.mU.mU.mU.mC.mU.mC.A.G.mU.mU.mC.A-chol | 1159 |
|  | 18639 | P.mU.G.A.A.fC.fU.G.A.G.A.A.A.fC*A*A*G*fC*A*G | 1160 |
| 18667 | 18640 | mU.A.mC.A.G.G.A.A.mC.A.G.mC.A-chol | 1161 |
|  | 18641 | P.mU.G.fC.fU.G.fU.fU.fC.fC.fU.G.fU.A*A*G*fU*fU*fU*G | 1162 |
| 18668 | 18642 | G.mC.A.G.G.mC.A.A.A.mC.mU.mU.A-chol | 1163 |
|  | 18643 | P.mU.A.A.G.fU.fU.fU.G.fC.fC.fU.G.fC*fC*fU*fC*fU*A*C | 1164 |
| 18669 | 18644 | A.A.mC.mU.mU.A.mC.A.G.G.A.A.A-chol | 1165 |
|  | 18645 | P.mU.fU.fU.fC.fC.fU.G.fU.A.A.G.fU.fU*fU*G*fC*fC*fU*G | 1166 |
| 18670 | 18646 | mC.A.mC.mU.G.mC.A.mU.mU.mU.mU.A.A-chol | 1167 |
|  | 18647 | P.mU.fU.A.A.A.A.fU.G.fC.A.G.fU.G*G*fC*fC*A*fU*U | 1168 |
| 18671 | 18648 | G.A.mC.A.mC.mC.A.mC.mU.G.mU.A.A-chol | 1169 |
|  | 18649 | P.mU.fU.A.fC.A.G.fU.G.G.fU.G.fU.fC*fU*G*fC*A*fU*G | 1170 |
| 18672 | 18650 | A.G.A.G.G.mC.A.G.G.mC.A.A.A-chol | 1171 |
|  | 18651 | P.mU.fU.fU.G.fC.fC.fU.G.fC.fC.fU.fC.fU*A*fC*A*fU*A*C | 1172 |
| 18673 | 18652 | mU.A.G.A.G.G.mC.A.G.G.mC.A.A-chol | 1173 |
|  | 18653 | P.mU.fU.G.fC.fC.fU.G.fC.fC.fU.fC.fU.A*fC*A*fU*A*fC*A | 1174 |
| 18674 | 18654 | G.A.G.A.G.mU.mU.mC.A.mU.mC.mU.A-chol | 1175 |
|  | 18655 | P.mU.A.G.A.fU.G.A.A.fC.fU.fC.fU.fC*fU*A*A*fU*fU*C | 1176 |
| 18675 | 18656 | mU.G.mU.G.A.A.mU.A.A.A.mU.mC.A-chol | 1177 |
|  | 18657 | P.mU.G.A.fU.fU.fU.A.fU.U.fC.A.fC.A*fC*fC*A*fC*A*A | 1178 |
| 18676 | 18658 | G.mU.G.A.A.mU.A.A.A.mU.mC.mU.A-chol | 1179 |
|  | 18659 | P.mU.A.G.A.fU.fU.fU.A.fU.fU.fC.A.fC*A*fC*fC*A*fC*A | 1180 |
| 18677 | 18660 | mU.G.A.AmU.A.A.A.mU.mC.mU.mU.A-chol | 1181 |
|  | 18661 | P.mU.A.A.G.A.fU.fU.fU.A.fU.U.fC.A*fC*A*fC*fC*A*C | 1182 |

TABLE 9

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 14840 | 5UTR/CDS | 155 | 1183 | AAGGAAAACUCACUACCAUGAGAAA | 4.4% |
| 14841 | 5UTR/CDS | 161 | 1184 | AACUCACUACCAUGAGAAUUGCAGA | 2.46% |
| 14842 | 5UTR/CDS | 163 | 1185 | CUCACUACCAUGAGAAUUGCAGUGA | 20.54% |
| 14843 | 5UTR/CDS | 164 | 1186 | UCACUACCAUGAGAAUUGCAGUGAA | 2.8% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 14844 | CDS | 168 | 1187 | UACCAUGAGAAUUGCAGUGAUUUGA | 3.6% |
| 14845 | CDS | 169 | 1188 | ACCAUGAGAAUUGCAGUGAUUUGCA | 5.2% |
| 14846 | CDS | 171 | 1189 | CAUGAGAAUUGCAGUGAUUUGCUUA | 0.8% |
| 14847 | CDS | 172 | 1190 | AUGAGAAUUGCAGUGAUUUGCUUUA | 0.95% |
| 14848 | CDS | 173 | 1191 | UGAGAAUUGCAGUGAUUUGCUUUUA | 3.2% |
| 14849 | CDS | 174 | 1192 | GAGAAUUGCAGUGAUUUGCUUUUGA | 4.14% |
| 14850 | CDS | 175 | 1193 | AGAAUUGCAGUGAUUUGCUUUUGCA | 2.9% |
| 14851 | CDS | 176 | 1194 | GAAUUGCAGUGAUUUGCUUUUGCCA | 8.38% |
| 14852 | CDS | 177 | 1195 | AAUUGCAGUGAUUUGCUUUUGCCUA | 4.6% |
| 14853 | CDS | 180 | 1196 | UGCAGUGAUUUGCUUUUGCCUCCUA | 11.1% |
| 14854 | CDS | 181 | 1197 | GCAGUGAUUUGCUUUUGCCUCCUAA | 10.87% |
| 14855 | CDS | 182 | 1198 | CAGUGAUUUGCUUUUGCCUCCUAGA | 5.3% |
| 14856 | CDS | 206 | 1199 | GCAUCACCUGUGCCAUACCAGUUAA | 15.29% |
| 14857 | CDS | 208 | 1200 | AUCACCUGUGCCAUACCAGUUAAAA | 22.6% |
| 14858 | CDS | 212 | 1201 | CCUGUGCCAUACCAGUUAAACAGGA | 13.3% |
| 14859 | CDS | 215 | 1202 | GUGCCAUACCAGUUAAACAGGCUGA | 21.2% |
| 14860 | CDS | 216 | 1203 | UGCCAUACCAGUUAAACAGGCUGAA | 20.24% |
| 14861 | CDS | 220 | 1204 | AUACCAGUUAAACAGGCUGAUUCUA | 12.5% |
| 14862 | CDS | 221 | 1205 | UACCAGUUAAACAGGCUGAUUCUGA | 9.9% |
| 14863 | CDS | 222 | 1206 | ACCAGUUAAACAGGCUGAUUCUGGA | 3.9% |
| 14864 | CDS | 225 | 1207 | AGUUAAACAGGCUGAUUCUGGAAGA | 20.48% |
| 14865 | CDS | 226 | 1208 | GUUAAACAGGCUGAUUCUGGAAGUA | 10.7% |
| 14866 | CDS | 227 | 1209 | UUAAACAGGCUGAUUCUGGAAGUUA | 22.75% |
| 14867 | CDS | 228 | 1210 | UAAACAGGCUGAUUCUGGAAGUUCA | 0.26% |
| 14868 | CDS | 234 | 1211 | GGCUGAUUCUGGAAGUUCUGAGGAA | 0.34% |
| 14869 | CDS | 236 | 1212 | CUGAUUCUGGAAGUUCUGAGGAAAA | 4.4% |
| 14870 | CDS | 238 | 1213 | GAUUCUGGAAGUUCUGAGGAAAAGA | 4.5% |
| 14871 | CDS | 239 | 1214 | AUUCUGGAAGUUCUGAGGAAAAGCA | 7.5% |
| 14872 | CDS | 240 | 1215 | UUCUGGAAGUUCUGAGGAAAAGCAA | 101.3% |
| 14873 | CDS | 338 | 1216 | CCCCACAGACCCUUCCAAGUAAGUA | 48.3% |
| 14874 | CDS | 340 | 1217 | CCACAGACCCUUCCAAGUAAGUCCA | 33.9% |
| 14875 | CDS | 342 | 1218 | ACAGACCCUUCCAAGUAAGUCCAAA | 16.1% |
| 14876 | CDS | 343 | 1219 | CAGACCCUUCCAAGUAAGUCCAACA | 38.7% |
| 14877 | CDS | 345 | 1220 | GACCCUUCCAAGUAAGUCCAACGAA | 54.2% |
| 14878 | CDS | 348 | 1221 | CCUUCCAAGUAAGUCCAACGAAAGA | 12.54% |
| 14879 | CDS | 349 | 1222 | CUUCCAAGUAAGUCCAACGAAAGCA | 32.44% |
| 14880 | CDS | 351 | 1223 | UCCAAGUAAGUCCAACGAAAGCCAA | 17.1% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 14881 | CDS | 353 | 1224 | CAAGUAAGUCCAACGAAAGCCAUGA | 32.94% |
| 14882 | CDS | 358 | 1225 | AAGUCCAACGAAAGCCAUGACCACA | 65.1% |
| 14883 | CDS | 362 | 1226 | CCAACGAAAGCCAUGACCACAUGGA | 76.9% |
| 14884 | CDS | 363 | 1227 | CAACGAAAGCCAUGACCACAUGGAA | 69.8% |
| 14885 | CDS | 366 | 1228 | CGAAAGCCAUGACCACAUGGAUGAA | 78.02% |
| 14886 | CDS | 372 | 1229 | CCAUGACCACAUGGAUGAUAUGGAA | 19.49% |
| 14887 | CDS | 377 | 1230 | ACCACAUGGAUGAUAUGGAUGAUGA | 20.43% |
| 14888 | CDS | 393 | 1231 | GGAUGAUGAAGAUGAUGAUGACCAA | 29.1% |
| 14889 | CDS | 394 | 1232 | GAUGAUGAAGAUGAUGAUGACCAUA | 24.5% |
| 14890 | CDS | 396 | 1233 | UGAUGAAGAUGAUGAUGACCAUGUA | 25.90% |
| 14891 | CDS | 398 | 1234 | AUGAAGAUGAUGAUGACCAUGUGGA | 20.5% |
| 14892 | CDS | 399 | 1235 | UGAAGAUGAUGAUGACCAUGUGGAA | 7.9% |
| 14893 | CDS | 430 | 1236 | GACUCCAUUGACUCGAACGACUCUA | 21.6% |
| 14894 | CDS | 431 | 1237 | ACUCCAUUGACUCGAACGACUCUGA | 13.5% |
| 14895 | CDS | 432 | 1238 | CUCCAUUGACUCGAACGACUCUGAA | 12.33% |
| 14896 | CDS | 435 | 1239 | CAUUGACUCGAACGACUCUGAUGAA | 42.5% |
| 14897 | CDS | 440 | 1240 | ACUCGAACGACUCUGAUGAUGUAGA | 22.54% |
| 14898 | CDS | 441 | 1241 | CUCGAACGACUCUGAUGAUGUAGAA | 17.4% |
| 14899 | CDS | 442 | 1242 | UCGAACGACUCUGAUGAUGUAGAUA | 11.2% |
| 14900 | CDS | 443 | 1243 | CGAACGACUCUGAUGAUGUAGAUGA | 20.7% |
| 14901 | CDS | 445 | 1244 | AACGACUCUGAUGAUGUAGAUGACA | 27.1% |
| 14902 | CDS | 449 | 1245 | ACUCUGAUGAUGUAGAUGACACUGA | 39.8% |
| 14903 | CDS | 450 | 1246 | CUCUGAUGAUGUAGAUGACACUGAA | 9.6% |
| 14904 | CDS | 451 | 1247 | UCUGAUGAUGUAGAUGACACUGAUA | 4.44% |
| 14905 | CDS | 452 | 1248 | CUGAUGAUGUAGAUGACACUGAUGA | 8.7% |
| 14906 | CDS | 453 | 1249 | UGAUGAUGUAGAUGACACUGAUGAA | 16.72% |
| 14907 | CDS | 461 | 1250 | UAGAUGACACUGAUGAUUCUCACCA | 42.9% |
| 14908 | CDS | 462 | 1251 | AGAUGACACUGAUGAUUCUCACCAA | 30.1% |
| 14909 | CDS | 469 | 1252 | ACUGAUGAUUCUCACCAGUCUGAUA | 9.1% |
| 14910 | CDS | 470 | 1253 | CUGAUGAUUCUCACCAGUCUGAUGA | 19.0% |
| 14911 | CDS | 471 | 1254 | UGAUGAUUCUCACCAGUCUGAUGAA | 42.1% |
| 14912 | CDS | 472 | 1255 | GAUGAUUCUCACCAGUCUGAUGAGA | 59.1% |
| 14913 | CDS | 476 | 1256 | AUUCUCACCAGUCUGAUGAGUCUCA | 38.2% |
| 14914 | CDS | 479 | 1257 | CUCACCAGUCUGAUGAGUCUCACCA | 34.1% |
| 14915 | CDS | 480 | 1258 | UCACCAGUCUGAUGAGUCUCACCAA | 48.45% |
| 14916 | CDS | 483 | 1259 | CCAGUCUGAUGAGUCUCACCAUUCA | 9.5% |
| 14917 | CDS | 484 | 1260 | CAGUCUGAUGAGUCUCACCAUUCUA | 21.5% |
| 14918 | CDS | 485 | 1261 | AGUCUGAUGAGUCUCACCAUUCUGA | 18.6% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 14919 | CDS | 486 | 1262 | GUCUGAUGAGUCUCACCAUUCUGAA | 20.2% |
| 14920 | CDS | 487 | 1263 | UCUGAUGAGUCUCACCAUUCUGAUA | 10.9% |
| 14921 | CDS | 488 | 1264 | CUGAUGAGUCUCACCAUUCUGAUGA | 18.9% |
| 14922 | CDS | 489 | 1265 | UGAUGAGUCUCACCAUUCUGAUGAA | 10.7% |
| 14923 | CDS | 490 | 1266 | GAUGAGUCUCACCAUUCUGAUGAAA | 28.15% |
| 14924 | CDS | 493 | 1267 | GAGUCUCACCAUUCUGAUGAAUCUA | 18.33% |
| 14925 | CDS | 495 | 1268 | GUCUCACCAUUCUGAUGAAUCUGAA | 7.61% |
| 14926 | CDS | 496 | 1269 | UCUCACCAUUCUGAUGAAUCUGAUA | 2.99% |
| 14927 | CDS | 497 | 1270 | CUCACCAUUCUGAUGAAUCUGAUGA | 7.44% |
| 14928 | CDS | 498 | 1271 | UCACCAUUCUGAUGAAUCUGAUGAA | 9.7% |
| 14929 | CDS | 499 | 1272 | CACCAUUCUGAUGAAUCUGAUGAAA | 16.96% |
| 14930 | CDS | 501 | 1273 | CCAUUCUGAUGAAUCUGAUGAACUA | 3.08% |
| 14931 | CDS | 505 | 1274 | UCUGAUGAAUCUGAUGAACUGGUCA | 13.24% |
| 14932 | CDS | 510 | 1275 | UGAAUCUGAUGAACUGGUCACUGAA | 3.16% |
| 14933 | CDS | 550 | 1276 | CCAGCAACCGAAGUUUUCACUCCAA | 14.02% |
| 14934 | CDS | 554 | 1277 | CAACCGAAGUUUUCACUCCAGUUGA | 3.10% |
| 14935 | CDS | 555 | 1278 | AACCGAAGUUUUCACUCCAGUUGUA | 5.27% |
| 14936 | CDS | 572 | 1279 | CAGUUGUCCCCACAGUAGACACAUA | 13.2% |
| 14937 | CDS | 573 | 1280 | AGUUGUCCCCACAGUAGACACAUAA | 27.01% |
| 14938 | CDS | 574 | 1281 | GUUGUCCCCACAGUAGACACAUAUA | 8.76% |
| 14939 | CDS | 588 | 1282 | AGACACAUAUGAUGGCCGAGGUGAA | 14.04% |
| 14940 | CDS | 589 | 1283 | GACACAUAUGAUGGCCGAGGUGAUA | 18.40% |
| 14941 | CDS | 598 | 1284 | GAUGGCCGAGGUGAUAGUGUGGUUA | 12.50% |
| 14942 | CDS | 601 | 1285 | GGCCGAGGUGAUAGUGUGGUUUAUA | 13.76% |
| 14943 | CDS | 602 | 1286 | GCCGAGGUGAUAGUGUGGUUUAUGA | 5.34% |
| 14944 | CDS | 603 | 1287 | CCGAGGUGAUAGUGUGGUUUAUGGA | 29.69% |
| 14945 | CDS | 604 | 1288 | CGAGGUGAUAGUGUGGUUUAUGGAA | 33.34% |
| 14946 | CDS | 606 | 1289 | AGGUGAUAGUGUGGUUUAUGGACUA | 17.50% |
| 14947 | CDS | 608 | 1290 | GUGAUAGUGUGGUUUAUGGACUGAA | 45.90% |
| 14948 | CDS | 609 | 1291 | UGAUAGUGUGGUUUAUGGACUGAGA | 22.0% |
| 14949 | CDS | 610 | 1292 | GAUAGUGUGGUUUAUGGACUGAGGA | 19.93% |
| 14950 | CDS | 611 | 1293 | AUAGUGUGGUUUAUGGACUGAGGUA | 17.34% |
| 14951 | CDS | 615 | 1294 | UGUGGUUUAUGGACUGAGGUCAAAA | 5.60% |
| 14952 | CDS | 617 | 1295 | UGGUUUAUGGACUGAGGUCAAAAUA | 25.74% |
| 14953 | CDS | 618 | 1296 | GGUUUAUGGACUGAGGUCAAAAUCA | 17.63% |
| 14954 | CDS | 619 | 1297 | GUUUAUGGACUGAGGUCAAAAUCUA | 3.45% |
| 14955 | CDS | 621 | 1298 | UUAUGGACUGAGGUCAAAAUCUAAA | 18.03% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 14956 | CDS | 622 | 1299 | UAUGGACUGAGGUCAAAAUCUAAGA | 20.98% |
| 14957 | CDS | 623 | 1300 | AUGGACUGAGGUCAAAAUCUAAGAA | 20.60% |
| 14958 | CDS | 624 | 1301 | UGGACUGAGGUCAAAAUCUAAGAAA | 26.73% |
| 14959 | CDS | 625 | 1302 | GGACUGAGGUCAAAAUCUAAGAAGA | 7.45% |
| 14960 | CDS | 626 | 1303 | GACUGAGGUCAAAAUCUAAGAAGUA | 14.1% |
| 14961 | CDS | 629 | 1304 | UGAGGUCAAAAUCUAAGAAGUUUCA | 8.61% |
| 14962 | CDS | 630 | 1305 | GAGGUCAAAAUCUAAGAAGUUUCGA | 19.07% |
| 14963 | CDS | 631 | 1306 | AGGUCAAAAUCUAAGAAGUUUCGCA | 6.08% |
| 14964 | CDS | 632 | 1307 | GGUCAAAAUCUAAGAAGUUUCGCAA | 19.82% |
| 14965 | CDS | 636 | 1308 | AAAAUCUAAGAAGUUUCGCAGACCA | 21.55% |
| 14966 | CDS | 637 | 1309 | AAAUCUAAGAAGUUUCGCAGACCUA | 30.20% |
| 14967 | CDS | 638 | 1310 | AAUCUAAGAAGUUUCGCAGACCUGA | 18.23% |
| 14968 | CDS | 686 | 1311 | ACGAGGACAUCACCUCACACAUGGA | 14.85% |
| 14969 | CDS | 687 | 1312 | CGAGGACAUCACCUCACACAUGGAA | 28.04% |
| 14970 | CDS | 689 | 1313 | AGGACAUCACCUCACACAUGGAAAA | 3.80% |
| 14971 | CDS | 698 | 1314 | CCUCACACAUGGAAAGCGAGGAGUA | 7.67% |
| 14972 | CDS | 703 | 1315 | CACAUGGAAAGCGAGGAGUUGAAUA | 5.8% |
| 14973 | CDS | 704 | 1316 | ACAUGGAAAGCGAGGAGUUGAAUGA | 5.3% |
| 14974 | CDS | 705 | 1317 | CAUGGAAAGCGAGGAGUUGAAUGGA | 24.47% |
| 14975 | CDS | 718 | 1318 | GAGUUGAAUGGUGCAUACAAGGCCA | 26.39% |
| 14976 | CDS | 785 | 1319 | GCCGUGGGAAGGACAGUUAUGAAAA | 7.60% |
| 14977 | CDS | 786 | 1320 | CCGUGGGAAGGACAGUUAUGAAACA | 8.75% |
| 14978 | CDS | 788 | 1321 | GUGGGAAGGACAGUUAUGAAACGAA | 8.34% |
| 14979 | CDS | 790 | 1322 | GGGAAGGACAGUUAUGAAACGAGUA | 5.38% |
| 14980 | CDS | 792 | 1323 | GAAGGACAGUUAUGAAACGAGUCAA | 11.45% |
| 14981 | CDS | 794 | 1324 | AGGACAGUUAUGAAACGAGUCAGCA | 11.78% |
| 14982 | CDS | 795 | 1325 | GGACAGUUAUGAAACGAGUCAGCUA | 10.69% |
| 14983 | CDS | 797 | 1326 | ACAGUUAUGAAACGAGUCAGCUGGA | 54.58% |
| 14984 | CDS | 798 | 1327 | CAGUUAUGAAACGAGUCAGCUGGAA | 33.9% |
| 14985 | CDS | 846 | 1328 | CCACAAGCAGUCCAGAUUAUAUAAA | 24.1% |
| 14986 | CDS | 850 | 1329 | AAGCAGUCCAGAUUAUAUAAGCGGA | 27.86% |
| 14987 | CDS | 854 | 1330 | AGUCCAGAUUAUAUAAGCGGAAAGA | 24.29% |
| 14988 | CDS | 855 | 1331 | GUCCAGAUUAUAUAAGCGGAAAGCA | 54.43% |
| 14989 | CDS | 859 | 1332 | AGAUUAUAUAAGCGGAAAGCCAAUA | 71.49% |
| 14990 | CDS | 860 | 1333 | GAUUAUAUAAGCGGAAAGCCAAUGA | 69.64% |
| 14991 | CDS | 861 | 1334 | AUUAUAUAAGCGGAAAGCCAAUGAA | 38.82% |
| 14992 | CDS | 862 | 1335 | UUAUAUAAGCGGAAAGCCAAUGAUA | 20.77% |
| 14993 | CDS | 865 | 1336 | UAUAAGCGGAAAGCCAAUGAUGAGA | 21.79% |

TABLE 9-continued

Inhibition of gene expression with hSPP1 ori sequences

| Duplex ID | Gene Region | Ref Pos | SEQ ID NO | hSPP1 Sense Strand Sequence | A549 0.1 nM Activity |
|---|---|---|---|---|---|
| 14994 | CDS | 866 | 1337 | AUAAGCGGAAAGCCAAUGAUGAGAA | 50.00% |
| 14995 | CDS | 867 | 1338 | UAAGCGGAAAGCCAAUGAUGAGAGA | 11.67% |
| 14996 | CDS | 870 | 1339 | GCGGAAAGCCAAUGAUGAGAGCAAA | 13.5% |
| 14997 | CDS | 871 | 1340 | CGGAAAGCCAAUGAUGAGAGCAAUA | 15.49% |
| 14998 | CDS | 872 | 1341 | GGAAAGCCAAUGAUGAGAGCAAUGA | 8.55% |
| 14999 | CDS | 873 | 1342 | GAAAGCCAAUGAUGAGAGCAAUGAA | 12.12% |
| 15000 | CDS | 875 | 1343 | AAGCCAAUGAUGAGAGCAAUGAGCA | 16.14% |
| 15001 | CDS | 878 | 1344 | CCAAUGAUGAGAGCAAUGAGCAUUA | 31.71% |
| 15002 | CDS | 879 | 1345 | CAAUGAUGAGAGCAAUGAGCAUUCA | 32.25% |
| 15003 | CDS | 881 | 1346 | AUGAUGAGAGCAAUGAGCAUUCCGA | 6.97% |
| 15004 | CDS | 883 | 1347 | GAUGAGAGCAAUGAGCAUUCCGAUA | 23.11% |
| 15005 | CDS | 885 | 1348 | UGAGAGCAAUGAGCAUUCCGAUGUA | 5.53% |
| 15006 | CDS | 890 | 1349 | GCAAUGAGCAUUCCGAUGUGAUUGA | 10.69% |
| 15007 | CDS | 893 | 1350 | AUGAGCAUUCCGAUGUGAUUGAUAA | 4.12% |
| 15008 | CDS | 894 | 1351 | UGAGCAUUCCGAUGUGAUUGAUAGA | 6.49% |
| 15009 | CDS | 895 | 1352 | GAGCAUUCCGAUGUGAUUGAUAGUA | 29.12% |
| 15010 | CDS | 897 | 1353 | GCAUUCCGAUGUGAUUGAUAGUCAA | 3.54% |
| 15011 | CDS | 899 | 1354 | AUUCCGAUGUGAUUGAUAGUCAGGA | 6.05% |
| 15012 | CDS | 901 | 1355 | UCCGAUGUGAUUGAUAGUCAGGAAA | 3.31% |
| 15013 | CDS | 906 | 1356 | UGUGAUUGAUAGUCAGGAACUUUCA | 12.71% |
| 15014 | CDS | 907 | 1357 | GUGAUUGAUAGUCAGGAACUUUCCA | 13.95% |
| 15015 | CDS | 909 | 1358 | GAUUGAUAGUCAGGAACUUUCCAAA | 4.03% |
| 15016 | CDS | 912 | 1359 | UGAUAGUCAGGAACUUUCCAAAGUC | 11.96% |
| 15017 | CDS | 913 | 1360 | GAUAGUCAGGAACUUUCCAAAGUCA | 14.01% |
| 15018 | CDS | 914 | 1361 | AUAGUCAGGAACUUUCCAAAGUCAA | 5.56% |
| 15019 | CDS | 916 | 1362 | AGUCAGGAACUUUCCAAAGUCAGCA | 13.92% |
| 15020 | CDS | 917 | 1363 | GUCAGGAACUUUCCAAAGUCAGCCA | 19.00% |
| 15021 | CDS | 923 | 1364 | AACUUUCCAAAGUCAGCCGUGAAUA | 17.56% |
| 15022 | CDS | 925 | 1365 | CUUUCCAAAGUCAGCCGUGAAUUCA | 19.58% |
| 15023 | CDS | 926 | 1366 | UUUCCAAAGUCAGCCGUGAAUUCCA | 6.54% |
| 15024 | CDS | 935 | 1367 | UCAGCCGUGAAUUCCACAGCCAUGA | 16.15% |
| 15025 | CDS | 936 | 1368 | CAGCCGUGAAUUCCACAGCCAUGAA | 20.62% |
| 15026 | CDS | 937 | 1369 | AGCCGUGAAUUCCACAGCCAUGAAA | 5.21% |
| 15027 | CDS | 943 | 1370 | GAAUUCCACAGCCAUGAAUUUCACA | 31.14% |
| 15028 | CDS | 944 | 1371 | AAUUCCACAGCCAUGAAUUUCACAA | 35.63% |
| 15029 | CDS | 945 | 1372 | AUUCCACAGCCAUGAAUUUCACAGA | 23.96% |
| 15030 | CDS | 946 | 1373 | UUCCACAGCCAUGAAUUUCACAGCA | 15.20% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 15031 | CDS | 947 | 1374 | UCCACAGCCAUGAAUUUCACAGCCA | 19.45% |
| 15032 | CDS | 950 | 1375 | ACAGCCAUGAAUUUCACAGCCAUGA | 25.74% |
| 15033 | CDS | 952 | 1376 | AGCCAUGAAUUUCACAGCCAUGAAA | 2.59% |
| 15034 | CDS | 953 | 1377 | GCCAUGAAUUUCACAGCCAUGAAGA | 6.00% |
| 15035 | CDS | 954 | 1378 | CCAUGAAUUUCACAGCCAUGAAGAA | 4.60% |
| 15036 | CDS | 956 | 1379 | AUGAAUUUCACAGCCAUGAAGAUAA | 9.20% |
| 15037 | CDS | 957 | 1380 | UGAAUUUCACAGCCAUGAAGAUAUA | 10.84% |
| 15038 | CDS | 958 | 1381 | GAAUUUCACAGCCAUGAAGAUAUGA | 40.20% |
| 15039 | CDS | 959 | 1382 | AAUUUCACAGCCAUGAAGAUAUGCA | 37.25% |
| 15040 | CDS | 960 | 1383 | AUUUCACAGCCAUGAAGAUAUGCUA | 8.21% |
| 15041 | CDS | 961 | 1384 | UUUCACAGCCAUGAAGAUAUGCUGA | 12.01% |
| 15042 | CDS | 964 | 1385 | CACAGCCAUGAAGAUAUGCUGGUUA | 12.25% |
| 15043 | CDS | 983 | 1386 | UGGUUGUAGACCCCAAAAGUAAGGA | 19.65% |
| 15044 | CDS | 984 | 1387 | GGUUGUAGACCCCAAAAGUAAGGAA | 28.19% |
| 15045 | CDS | 985 | 1388 | GUUGUAGACCCCAAAAGUAAGGAAA | 17.92% |
| 15046 | CDS | 986 | 1389 | UUGUAGACCCCAAAAGUAAGGAAGA | 7.94% |
| 15047 | CDS | 987 | 1390 | UGUAGACCCCAAAAGUAAGGAAGAA | 15.09% |
| 15048 | CDS | 988 | 1391 | GUAGACCCCAAAAGUAAGGAAGAAA | 20.01% |
| 15049 | CDS | 989 | 1392 | UAGACCCCAAAAGUAAGGAAGAAGA | 7.25% |
| 15050 | CDS | 990 | 1393 | AGACCCCAAAAGUAAGGAAGAAGAA | 12.42% |
| 15051 | CDS | 995 | 1394 | CCAAAAGUAAGGAAGAAGAUAAACA | 8.96% |
| 15052 | CDS | 996 | 1395 | CAAAAGUAAGGAAGAAGAUAAACAA | 6.85% |
| 15053 | CDS | 997 | 1396 | AAAAGUAAGGAAGAAGAUAAACACA | 14.15% |
| 15054 | CDS | 998 | 1397 | AAAGUAAGGAAGAAGAUAAACACCA | 12.32% |
| 15055 | CDS | 999 | 1398 | AAGUAAGGAAGAAGAUAAACACCUA | 8.83% |
| 15056 | CDS | 1001 | 1399 | GUAAGGAAGAAGAUAAACACCUGAA | 15.09% |
| 15057 | CDS | 1002 | 1400 | UAAGGAAGAAGAUAAACACCUGAAA | 4.91% |
| 15058 | CDS | 1007 | 1401 | AAGAAGAUAAACACCUGAAAUUUCA | 1.43% |
| 15059 | CDS | 1008 | 1402 | AGAAGAUAAACACCUGAAAUUUCGA | 3.51% |
| 15060 | CDS | 1009 | 1403 | GAAGAUAAACACCUGAAAUUUCGUA | 15.12% |
| 15061 | CDS | 1010 | 1404 | AAGAUAAACACCUGAAAUUUCGUAA | 28.56% |
| 15062 | CDS | 1013 | 1405 | AUAAACACCUGAAAUUUCGUAUUUA | 5.74% |
| 15063 | CDS | 1015 | 1406 | AAACACCUGAAAUUUCGUAUUUCUA | 13.01% |
| 15064 | CDS | 1024 | 1407 | AAAUUUCGUAUUUCUCAUGAAUUAA | 15.54% |
| 15065 | CDS | 1030 | 1408 | CGUAUUUCUCAUGAAUUAGAUAGUA | 9.47% |
| 15066 | CDS | 1031 | 1409 | GUAUUUCUCAUGAAUUAGAUAGUGA | 30.03% |
| 15067 | CDS | 1032 | 1410 | UAUUUCUCAUGAAUUAGAUAGUGCA | 5.31% |
| 15068 | CDS | 1036 | 1411 | UCUCAUGAAUUAGAUAGUGCAUCUA | 9.74% |

TABLE 9-continued

Inhibition of gene expression with hSPP1 ori sequences

| Duplex ID | Target Gene Region | Ref Pos | SEQ ID NO | hSPP1 Sense Strand Sequence | A549 0.1 nM Activity |
|---|---|---|---|---|---|
| 15069 | CDS | 1037 | 1412 | CUCAUGAAUUAGAUAGUGCAUCUUA | 10.78% |
| 15070 | CDS | 1038 | 1413 | UCAUGAAUUAGAUAGUGCAUCUUCA | 91.87% |
| 15071 | CDS | 1039 | 1414 | CAUGAAUUAGAUAGUGCAUCUUCUA | 93.82% |
| 15072 | CDS | 1040 | 1415 | AUGAAUUAGAUAGUGCAUCUUCUGA | 96.06% |
| 15073 | CDS | 1041 | 1416 | UGAAUUAGAUAGUGCAUCUUCUGAA | 94.91% |
| 15074 | CDS | 1042 | 1417 | GAAUUAGAUAGUGCAUCUUCUGAGA | 97.91% |
| 15075 | CDS | 1043 | 1418 | AAUUAGAUAGUGCAUCUUCUGAGGA | 93.76% |
| 15076 | CDS | 1044 | 1419 | AUUAGAUAGUGCAUCUUCUGAGGUA | 103.92% |
| 15077 | CDS | 1045 | 1420 | UUAGAUAGUGCAUCUUCUGAGGUCA | 95.85% |
| 15078 | CDS/3UTR | 1052 | 1421 | GUGCAUCUUCUGAGGUCAAUUAAAA | 93.83% |
| 15079 | CDS/3UTR | 1053 | 1422 | UGCAUCUUCUGAGGUCAAUUAAAAA | 90.69% |
| 15080 | CDS/3UTR | 1054 | 1423 | GCAUCUUCUGAGGUCAAUUAAAAGA | 101.49% |
| 15081 | CDS/3UTR | 1055 | 1424 | CAUCUUCUGAGGUCAAUUAAAAGGA | 110.27% |
| 15082 | CDS/3UTR | 1056 | 1425 | AUCUUCUGAGGUCAAUUAAAAGGAA | 99.36% |
| 15083 | CDS/3UTR | 1057 | 1426 | UCUUCUGAGGUCAAUUAAAAGGAGA | 95.31% |
| 15084 | CDS/3UTR | 1058 | 1427 | CUUCUGAGGUCAAUUAAAAGGAGAA | 15.55% |
| 15085 | 3UTR | 1081 | 1428 | AAAAAAUACAAUUUCUCACUUUGCA | 3.59% |
| 15086 | 3UTR | 1083 | 1429 | AAAAUACAAUUUCUCACUUUGCAUU | 3.46% |
| 15087 | 3UTR | 1086 | 1430 | AUACAAUUUCUCACUUUGCAUUUAG | 2.37% |
| 15088 | 3UTR | 1087 | 1431 | UACAAUUUCUCACUUUGCAUUUAGU | 3.54% |
| 15089 | 3UTR | 1088 | 1432 | ACAAUUUCUCACUUUGCAUUUAGUC | 2.85% |
| 15090 | 3UTR | 1089 | 1433 | CAAUUUCUCACUUUGCAUUUAGUCA | 2.35% |
| 15091 | 3UTR | 1093 | 1434 | UUCUCACUUUGCAUUUAGUCAAAAG | 1.38% |
| 15092 | 3UTR | 1125 | 1435 | GCUUUAUAGCAAAAUGAAAGAGAAC | 4.11% |
| 15093 | 3UTR | 1127 | 1436 | UUUAUAGCAAAAUGAAAGAGAACAU | 3.91% |
| 15094 | 3UTR | 1128 | 1437 | UUAUAGCAAAAUGAAAGAGAACAUG | 3.59% |
| 15095 | 3UTR | 1147 | 1438 | AACAUGAAAUGCUUCUUUCUCAGUU | 1.80% |
| 15096 | 3UTR | 1148 | 1439 | ACAUGAAAUGCUUCUUUCUCAGUUU | 2.17% |
| 15097 | 3UTR | 1150 | 1440 | AUGAAAUGCUUCUUUCUCAGUUUAU | 2.93% |
| 15098 | 3UTR | 1153 | 1441 | AAAUGCUUCUUUCUCAGUUUAUGG | 2.18% |
| 15099 | 3UTR | 1154 | 1442 | AAUGCUUCUUUCUCAGUUUAUGGU | 3.92% |
| 15100 | 3UTR | 1156 | 1443 | UGCUUCUUUCUCAGUUUAUGGUUG | 4.08% |
| 15101 | 3UTR | 1157 | 1444 | GCUUCUUUCUCAGUUUAUGGUUGA | 1.74% |
| 15102 | 3UTR | 1158 | 1445 | CUUCUUUCUCAGUUUAUGGUUGAA | 4.74% |
| 15103 | 3UTR | 1159 | 1446 | UUCUUUCUCAGUUUAUGGUUGAAU | 2.65% |
| 15104 | 3UTR | 1168 | 1447 | AGUUUAUGGUUGAAUGUGUAUCUA | 2.57% |
| 15105 | 3UTR | 1178 | 1448 | UUGAAUGUGUAUCUAUUUGAGUCUG | 3.76% |

TABLE 9-continued

Inhibition of gene expression with hSPP1 ori sequences

| Target Gene Duplex ID | Gene Region | Ref Pos | SEQ ID NO | hSPP1 Sense Strand Sequence | A549 0.1 nM Activity |
|---|---|---|---|---|---|
| 15106 | 3UTR | 1179 | 1449 | UGAAUGUGUAUCUAUUUGAGUCUGG | 2.91% |
| 15107 | 3UTR | 1183 | 1450 | UGUGUAUCUAUUUGAGUCUGGAAAU | 0.62% |
| 15108 | 3UTR | 1184 | 1451 | GUGUAUCUAUUUGAGUCUGGAAAUA | 2.45% |
| 15109 | 3UTR | 1186 | 1452 | GUAUCUAUUUGAGUCUGGAAAUAAC | 2.18% |
| 15110 | 3UTR | 1191 | 1453 | UAUUUGAGUCUGGAAAUAACUAAUG | 2.44% |
| 15111 | 3UTR | 1218 | 1454 | UUUGAUAAUUAGUUUAGUUUGUGGC | 19.35% |
| 15112 | 3UTR | 1219 | 1455 | UUGAUAAUUAGUUUAGUUUGUGGCU | 6.19% |
| 15113 | 3UTR | 1222 | 1456 | AUAAUUAGUUUAGUUUGUGGCUUCA | 3.25% |
| 15114 | 3UTR | 1224 | 1457 | AAUUAGUUUAGUUUGUGGCUUCAUG | 2.47% |
| 15115 | 3UTR | 1225 | 1458 | AUUAGUUUAGUUUGUGGCUUCAUGG | 2.28% |
| 15116 | 3UTR | 1226 | 1459 | UUAGUUUAGUUUGUGGCUUCAUGGA | 3.40% |
| 15117 | 3UTR | 1227 | 1460 | UAGUUUAGUUUGUGGCUUCAUGGAA | 4.12% |
| 15118 | 3UTR | 1244 | 1461 | UCAUGGAAACUCCCUGUAAACUAAA | 2.63% |
| 15119 | 3UTR | 1245 | 1462 | CAUGGAAACUCCCUGUAAACUAAAA | 2.20% |
| 15120 | 3UTR | 1246 | 1463 | AUGGAAACUCCCUGUAAACUAAAAG | 3.56% |
| 15121 | 3UTR | 1247 | 1464 | UGGAAACUCCCUGUAAACUAAAAGC | 3.73% |
| 15122 | 3UTR | 1248 | 1465 | GGAAACUCCCUGUAAACUAAAAGCU | 2.43% |
| 15123 | 3UTR | 1249 | 1466 | GAAACUCCCUGUAAACUAAAAGCUU | 2.28% |
| 15124 | 3UTR | 1251 | 1467 | AACUCCCUGUAAACUAAAAGCUUCA | 5.40% |
| 15125 | 3UTR | 1253 | 1468 | CUCCCUGUAAACUAAAAGCUUCAGG | 8.21% |
| 15126 | 3UTR | 1286 | 1469 | UAUGUUCAUUCUAUAGAAGAAAUGC | 3.17% |
| 15127 | 3UTR | 1294 | 1470 | UUCUAUAGAAGAAAUGCAAACUAUC | 2.45% |
| 15128 | 3UTR | 1295 | 1471 | UCUAUAGAAGAAAUGCAAACUAUCA | 3.97% |
| 15129 | 3UTR | 1296 | 1472 | CUAUAGAAGAAAUGCAAACUAUCAC | 3.86% |
| 15130 | 3UTR | 1297 | 1473 | UAUAGAAGAAAUGCAAACUAUCACU | 1.84% |
| 15131 | 3UTR | 1299 | 1474 | UAGAAGAAAUGCAAACUAUCACUGU | 2.53% |
| 15132 | 3UTR | 1302 | 1475 | AAGAAAUGCAAACUAUCACUGUAUU | 2.25% |
| 15133 | 3UTR | 1303 | 1476 | AGAAAUGCAAACUAUCACUGUAUUU | 3.32% |
| 15134 | 3UTR | 1357 | 1477 | AUUUAUGUAGAAGCAAACAAAAUAC | 1.86% |
| 15135 | 3UTR | 1465 | 1478 | UAUCUUUUGUGGUGUGAAUAAAUC | 3.40% |
| 15136 | 3UTR | 1466 | 1479 | AUCUUUUGUGGUGUGAAUAAAUCU | 3.49% |
| 15137 | 3UTR | 1467 | 1480 | UCUUUUGUGGUGUGAAUAAAUCUU | 3.03% |
| 15138 | 3UTR | 1468 | 1481 | CUUUUGUGGUGUGAAUAAAUCUUU | 3.62% |
| 15139 | 3UTR | 1496 | 1482 | CUUGAAUGUAAUAAGAAUUUGGUGG | 61.48% |
| 15140 | 3UTR | 1497 | 1483 | UUGAAUGUAAUAAGAAUUUGGUGGU | 71.54% |
| 15141 | 3UTR | 1504 | 1484 | UAAUAAGAAUUUGGUGGUGUCAAUU | 58.54% |
| 15142 | 3UTR | 1511 | 1485 | AAUUUGGUGGUGUCAAUUGCUUAUU | 56.93% |
| 15143 | 3UTR | 1512 | 1486 | AUUUGGUGGUGUCAAUUGCUUAUUU | 81.22% |

TABLE 9-continued

Inhibition of gene expression with hSPP1 ori sequences

| Target Gene Duplex ID | Gene Region | hSPP1 Ref Pos | SEQ ID NO | Sense Strand Sequence | A549 0.1 nM Activity |
|---|---|---|---|---|---|
| 15144 | 3UTR | 1513 | 1487 | UUUGGUGGUGUCAAUUGCUUAUUUG | 59.16% |
| 15145 | 3UTR | 1514 | 1488 | UUGGUGGUGUCAAUUGCUUAUUUGU | 59.46% |
| 15146 | 3UTR | 1540 | 1489 | UUCCCACGGUUGUCCAGCAAUUAAU | 67.40% |

TABLE 10 hCTGF sd-rxRNA

| Target Gene Duplex ID | CTGF Single Strand ID | sd-rxRNA sequence | SEQ ID NO |
|---|---|---|---|
| 17356 | 17007 | A.mC.A.mU.U.A.A.mC.mU.mC.A.mU.A.Chl | 1490 |
|  | 17009 | P.mU.A.fU.G.A.G.fU.fU.A.A.fU.G.fU*fC*fU*fC*fU*fC*A | 1491 |
| 17357 | 17008 | G.A.mC.A.mU.U.A.A.mC.mU.mC.A.mU.A.Chl | 1492 |
|  | 17009 | P.mU.A.fU.G.A.G.fU.fU.A.A.fU.G.fU*fC*fU*fC*fU*fC*A | 1493 |
| 17358 | 17010 | mU.G.A.A.G.A.A.mU.G.mU.U.A.A.Chl | 1494 |
|  | 17012 | P.mU.fU.A.A.fC.A.fU.fU.fC.fU.fU.fC.A*A*A*fC*fC*A*G | 1495 |
| 17359 | 17011 | mU.mU.G.A.A.G.A.A.mU.G.mU.U.A.A.Chl | 1496 |
|  | 17012 | P.mU.fU.A.A.fC.A.fU.fU.fC.fU.fU.fC.A*A*A*fC*fC*A*G | 1497 |
| 17360 | 17013 | G.A.mU.A.G.mC.A.mU.mC.mU.U.A.A.Chl | 1498 |
|  | 17015 | P.mU.fU.A.A.G.A.fU.G.fC.fU.A.fU.fC*fU*G*A*fU*G*A | 1499 |
| 17361 | 17014 | A.G.A.mU.A.G.mC.A.mU.mC.mU.U.A.A.Chl | 1500 |
|  | 17015 | P.mU.fU.A.A.G.A.fU.G.fC.fU.A.fU.fC*fU*G*A*fU*G*A | 1501 |
| 17362 | 17016 | mU.G.A.A.G.mU.G.mU.U.A.A.mU.U.A.Chl | 1502 |
|  | 17017 | P.mU.A.A.fU.fU.A.fC.A.fC.fU.fU.fC.A*A*A*fU*A*G*C | 1503 |
| 17363 | 17018 | A.A.mU.mU.G.A.G.A.A.G.G.A.A.Chl | 1504 |
|  | 17019 | P.mU.fU.fC.fC.fU.fU.fC.fU.fC.A.A.fU.fU*A*fC*A*fC*fU*U | 1505 |
| 17364 | 17020 | mU.mU.G.A.G.A.A.G.G.A.A.A.A.Chl | 1506 |
|  | 17021 | P.mU.fU.fU.fU.fC.fC.fU.fU.fC.fU.fC.A.A*fU*fU*A*fC*A*C | 1507 |
| 17365 | 17022 | mC.A.mU.mU.mC.mU.G.A.mU.mU.mC.G.A.Chl | 1508 |
|  | 17023 | P.mU.fC.G.A.A.fU.fC.A.G.A.A.fU.G*fU*fC*A*G*A*G | 1509 |
| 17366 | 17024 | mU.mU.mC.mU.G.A.mU.mU.mC.G.A.A.A.Chl | 1510 |
|  | 17025 | P.mU.fU.fU.fC.G.A.A.fU.fC.A.G.A.A*fU*G*fU*fC*A*G | 1511 |
| 17367 | 17026 | mC.mU.G.mU.mC.G.A.mU.mU.A.G.A.A.Chl | 1512 |
|  | 17027 | P.mU.fU.fC.fU.A.A.fU.fC.G.A.fC.A.G*G*A*fU*fU*fC*C | 1513 |
| 17368 | 17028 | mU.mU.mU.G.mC.mC.mU.G.mU.A.A.mC.A.Chl | 1514 |
|  | 17030 | P.mU.G.fU.fU.A.fC.A.G.G.fC.A.A.A*fU*fU*fC*A*fC*U | 1515 |
| 17369 | 17029 | A.mU.mU.mU.G.mC.mC.mU.G.mU.A.A.mC.A.Chl | 1516 |
|  | 17030 | P.mU.G.fU.fU.A.fC.A.G.G.fC.A.A.A*fU*fU*fC*A*fC*U | 1517 |
| 17370 | 17031 | A.mC.A.A.G.mC.mC.A.G.A.mU.U.A.Chl | 1518 |
|  | 17033 | P.mU.A.A.fU.fC.fU.G.G.fC.fU.fU.G.fU*fU*A*fC*A*G*G | 1519 |
| 17371 | 17032 | "A.A.mC.A.A.G.mC.mC.A.G.A.mU.U.A.Chl | 1520 |
|  | 17033 | P.mU.A.A.fU.fC.fU.G.G.fC.fU.fU.G.fU*fU*A*fC*A*G*G | 1521 |
| 17372 | 17034 | mC.A.G.mU.mU.A.mU.mU.mU.G.mU.A.Chl | 1522 |
|  | 17035 | P.mU.A.fC.A.A.A.fU.A.A.A.fC.fU.G*fU*fC*fC*G*A*A | 1523 |
| 17373 | 17036 | mU.G.mU.mU.G.A.G.A.G.mU.G.mU.A.Chl | 1524 |
|  | 17038 | P.mU.A.fC.A.fC.fU.fC.fU.fC.A.A.fC.A*A*A*fU*A*A*A | 1525 |
| 17374 | 17037 | mU.mU.G.mU.mU.G.A.G.A.G.mU.G.mU.A.Chl | 1526 |
|  | 17038 | P.mU.A.fC.A.fC.fU.fC.fU.fC.A.A.fC.A*A*A*fU*A*A*A | 1527 |

TABLE 10-continued hCTGF sd-rxRNA

| Target Gene Duplex ID | CTGF Single Strand ID | sd-rxRNA sequence | SEQ ID NO |
|---|---|---|---|
| 17375 | 17039 | mU.G.mC.A.mC.mC.mU.mU.mU.mC.mU.A.A.Chl | 1528 |
| | 17041 | P.mU.fU.A.G.A.A.A.G.G.fU.G.fC.A*A*A*fC*A*fU*G | 1529 |
| 17376 | 17040 | mU.mU.G.mC.A.mC.mC.mU.mU.mU.mC.mU.A.A.Chl | 1530 |
| | 17041 | P.mU.fU.A.G.A.A.A.G.G.fU.G.fC.A*A*A*fC*A*fU*G | 1531 |
| 17377 | 17042 | mU.mU.G.A.G.mC.mU.mU.mU.mC.mU.G.A.Chl | 1532 |
| | 17043 | P.mU.fC.A.G.A.A.A.G.fC.fU.fC.A.A*A*fC*fU*fU*G*A | 1533 |
| 17378 | 17044 | mU.G.A.G.A.G.mU.mU.G.A.mC.A.Chl | 1534 |
| | 17045 | P.mU.G.fU.fC.A.fC.A.fC.fU.fC.fU.fC.A*A*fC*A*A*A*U | 1535 |
| 17379 | 17046 | A.G.mU.G.mU.G.A.mC.mC.A.A.A.A.Chl | 1536 |
| | 17048 | P.mU.fU.fU.fU.G.G.fU.fC.A.fC.A.fC.fU*fC*fU*fC*A*A*C | 1537 |
| 17380 | 17047 | G.A.G.mU.G.mU.G.A.mC.mC.A.A.A.A.Chl | 1538 |
| | 17048 | P.mU.fU.fU.fU.G.G.fU.fC.A.fC.A.fC.fU*fC*fU*fC*A*A*C | 1539 |
| 17381 | 17049 | G.mU.G.mU.G.A.mC.mC.A.A.A.A.A.Chl | 1540 |
| | 17050 | P.mU.fU.fU.fU.fU.G.G.fU.fC.A.fC.A.fC.fU*fC*fU*fU*fC*A*A | 1541 |
| 17382 | 17051 | mU.G.mU.G.A.mC.mC.A.A.A.A.G.A.Chl | 1542 |
| | 17053 | P.mU.fC.fU.fU.fU.fU.G.G.fU.fC.A.fC.A*fC*fU*fC*fU*fC*A | 1543 |
| 17383 | 17052 | G.mU.G.mU.G.A.mC.mC.A.A.A.A.G.A.Chl | 1544 |
| | 17053 | P.mU.fC.fU.fU.fU.fU.G.G.fU.fC.A.fC.A*fC*fU*fC*fU*fC*A | 1545 |
| 17384 | 17054 | G.mU.G.A.mC.mC.A.A.A.A.G.mU.A.Chl | 1546 |
| | 17055 | P.mU.A.fC.fU.fU.fU.G.G.fU.fC.A.fC*A*fC*fU*fC*fU*C | 1547 |
| 17385 | 17056 | G.A.mC.mC.A.A.A.A.G.mU.mU.A.A.Chl | 1548 |
| | 17057 | P.mU.fU.A.A.fC.fU.fU.fU.G.G.fU.fC*A*fC*A*fC*fU*C | 1549 |
| 17386 | 17058 | G.mC.A.mC.mC.mU.mU.mU.mC.mU.A.G.A.Chl | 1550 |
| | 17059 | P.mU.fC.fU.A.G.A.A.A.G.G.fU.G.fC*A*A*A*fC*A*U | 1551 |
| 17387 | 17060 | mC.mC.mU.mU.mU.mC.mU.A.G.mU.mU.G.A.Chl | 1552 |
| | 17061 | P.mU.fC.A.A.fC.fU.A.G.A.A.A.G*fU*G*fC*A*A | 1553 |

TABLE 11

Inhibition of gene expression with hCTGF ori sequences

| Target Gene Duplex | Gene Name | Gene Region | Ref Pos | SEQ ID NO | CTGF Sense sequence | % Expression (0.1 nM) |
|---|---|---|---|---|---|---|
| 14542 | | CDS | 774 | 1554 | UUUGGCCCAGACCCAACUAUGAUUA | 96% |
| 14543 | | CDS | 776 | 1555 | UGGCCCAGACCCAACUAUGAUUAGA | 94% |
| 14544 | | CDS | 785 | 1556 | CCCAACUAUGAUUAGAGCCAACUGA | 55% |
| 14545 | | CDS | 786 | 1557 | CCAACUAUGAUUAGAGCCAACUGCA | 89% |
| 14546 | | CDS | 934 | 1558 | CUUGCGAAGCUGACCUGGAAGAGAA | 63% |
| 14547 | | CDS | 938 | 1559 | CGAAGCUGACCUGGAAGAGAACAUA | 70% |
| 14548 | | CDS | 940 | 1560 | AAGCUGACCUGGAAGAGAACAUUAA | 65% |
| 14549 | | CDS | 941 | 1561 | AGCUGACCUGGAAGAGAACAUUAAA | 81% |
| 14550 | | CDS | 943 | 1562 | CUGACCUGGAAGAGAACAUUAAGAA | 85% |
| 14551 | | CDS | 944 | 1563 | UGACCUGGAAGAGAACAUUAAGAAA | 61% |
| 14552 | | CDS | 945 | 1564 | GACCUGGAAGAGAACAUUAAGAAGA | 73% |
| 14553 | | CDS | 983 | 1565 | CCGUACUCCCAAAAUCUCCAAGCCA | 86% |
| 14554 | | CDS | 984 | 1566 | CGUACUCCCAAAAUCUCCAAGCCUA | 64% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14555 | | CDS | 985 | 1567 | GUACUCCCAAAAUCUCCAAGCCUAA | 71% |
| 14556 | | CDS | 986 | 1568 | UACUCCCAAAAUCUCCAAGCCUAUA | 71% |
| 14557 | | CDS | 987 | 1569 | ACUCCCAAAAUCUCCAAGCCUAUCA | 84% |
| 14558 | | CDS | 988 | 1570 | CUCCCAAAAUCUCCAAGCCUAUCAA | 64% |
| 14559 | | CDS | 989 | 1571 | UCCCAAAAUCUCCAAGCCUAUCAAA | 64% |
| 14560 | | CDS | 990 | 1572 | CCCAAAAUCUCCAAGCCUAUCAAGA | 87% |
| 14561 | | CDS | 1002 | 1573 | AAGCCUAUCAAGUUUGAGCUUUCUA | 46% |
| 14562 | | CDS | 1003 | 1574 | AGCCUAUCAAGUUUGAGCUUUCUGA | 30% |
| 14563 | | CDS | 1004 | 1575 | GCCUAUCAAGUUUGAGCUUUCUGGA | 63% |
| 14564 | | CDS | 1008 | 1576 | AUCAAGUUUGAGCUUUCUGGCUGCA | 77% |
| 14565 | | CDS | 1025 | 1577 | UGGCUGCACCAGCAUGAAGACAUAA | 96% |
| 14566 | | CDS | 1028 | 1578 | CUGCACCAGCAUGAAGACAUACCGA | 79% |
| 14567 | | CDS | 1029 | 1579 | UGCACCAGCAUGAAGACAUACCGAA | 58% |
| 14568 | | CDS | 1033 | 1580 | CCAGCAUGAAGACAUACCGAGCUAA | 59% |
| 14569 | | CDS | 1035 | 1581 | AGCAUGAAGACAUACCGAGCUAAAA | 76% |
| 14570 | | CDS | 1036 | 1582 | GCAUGAAGACAUACCGAGCUAAAUA | 71% |
| 14571 | | CDS | 1050 | 1583 | CGAGCUAAAUUCUGUGGAGUAUGUA | 73% |
| 14572 | | CDS | 1051 | 1584 | GAGCUAAAUUCUGUGGAGUAUGUAA | 72% |
| 14573 | | CDS | 1053 | 1585 | GCUAAAUUCUGUGGAGUAUGUACCA | 87% |
| 14574 | | CDS | 1054 | 1586 | CUAAAUUCUGUGGAGUAUGUACCGA | 83% |
| 14575 | | CDS | 1135 | 1587 | CUGACGGCGAGGUCAUGAAGAAGAA | 77% |
| 14576 | | CDS | 1138 | 1588 | ACGGCGAGGUCAUGAAGAAGAACAA | 72% |
| 14577 | | CDS | 1139 | 1589 | CGGCGAGGUCAUGAAGAAGAACAUA | 85% |
| 14578 | | CDS | 1143 | 1590 | GAGGUCAUGAAGAAGAACAUGAUGA | 83% |
| 14579 | | CDS | 1145 | 1591 | GGUCAUGAAGAAGAACAUGAUGUUA | 91% |
| 14580 | | CDS | 1148 | 1592 | CAUGAAGAAGAACAUGAUGUUCAUA | 92% |
| 14581 | | CDS | 1157 | 1593 | GAACAUGAUGUUCAUCAAGACCUGA | 84% |
| 14582 | | CDS | 1161 | 1594 | AUGAUGUUCAUCAAGACCUGUGCCA | 92% |
| 14583 | | CDS | 1203 | 1595 | GGAGACAAUGACAUCUUUGAAUCGA | 62% |
| 14584 | | CDS | 1204 | 1596 | GAGACAAUGACAUCUUUGAAUCGCA | 56% |
| 14585 | | CDS | 1205 | 1597 | AGACAAUGACAUCUUUGAAUCGCUA | 30% |
| 14586 | | CDS | 1206 | 1598 | GACAAUGACAUCUUUGAAUCGCUGA | 47% |
| 14587 | | CDS | 1207 | 1599 | ACAAUGACAUCUUUGAAUCGCUGUA | 29% |
| 14588 | | CDS | 1208 | 1600 | CAAUGACAUCUUUGAAUCGCUGUAA | 50% |
| 14589 | | CDS | 1209 | 1601 | AAUGACAUCUUUGAAUCGCUGUACA | 39% |
| 14590 | | CDS | 1210 | 1602 | AUGACAUCUUUGAAUCGCUGUACUA | 44% |
| 14591 | | CDS | 1211 | 1603 | UGACAUCUUUGAAUCGCUGUACUAA | 39% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14592 | CDS | 1212 | 1604 | GACAUCUUUGAAUCGCUGUACUACA | 55% |
| 14593 | CDS | 1213 | 1605 | ACAUCUUUGAAUCGCUGUACUACAA | 59% |
| 14594 | CDS | 1216 | 1606 | UCUUUGAAUCGCUGUACUACAGGAA | 80% |
| 14595 | CDS | 1217 | 1607 | CUUUGAAUCGCUGUACUACAGGAAA | 80% |
| 14596 | CDS | 1223 | 1608 | AUCGCUGUACUACAGGAAGAUGUAA | 59% |
| 14597 | CDS | 1224 | 1609 | UCGCUGUACUACAGGAAGAUGUACA | 62% |
| 14598 | CDS | 1239 | 1610 | AAGAUGUACGGAGACAUGGCAUGAA | 59% |
| 14599 | CDS | 1253 | 1611 | CAUGGCAUGAAGCCAGAGAGUGAGA | 65% |
| 14600 | 3UTR | 1266 | 1612 | CAGAGAGUGAGAGACAUUAACUCAA | 43% |
| 14601 | 3UTR | 1267 | 1613 | AGAGAGUGAGAGACAUUAACUCAUA | 25% |
| 14602 | 3UTR | 1268 | 1614 | GAGAGUGAGAGACAUUAACUCAUUA | 33% |
| 14603 | 3UTR | 1269 | 1615 | AGAGUGAGAGACAUUAACUCAUUAA | 42% |
| 14604 | 3UTR | 1270 | 1616 | GAGUGAGAGACAUUAACUCAUUAGA | 28% |
| 14605 | 3UTR | 1271 | 1617 | AGUGAGAGACAUUAACUCAUUAGAA | 34% |
| 14606 | 3UTR | 1272 | 1618 | GUGAGAGACAUUAACUCAUUAGACA | 30% |
| 14607 | 3UTR | 1273 | 1619 | UGAGAGACAUUAACUCAUUAGACUA | 33% |
| 14608 | 3UTR | 1275 | 1620 | AGAGACAUUAACUCAUUAGACUGGA | 42% |
| 14609 | 3UTR | 1277 | 1621 | AGACAUUAACUCAUUAGACUGGAAA | 25% |
| 14610 | 3UTR | 1278 | 1622 | GACAUUAACUCAUUAGACUGGAACA | 31% |
| 14611 | 3UTR | 1279 | 1623 | ACAUUAACUCAUUAGACUGGAACUA | 32% |
| 14612 | 3UTR | 1281 | 1624 | AUUAACUCAUUAGACUGGAACUUGA | 23% |
| 14613 | 3UTR | 1284 | 1625 | AACUCAUUAGACUGGAACUUGAACA | 39% |
| 14614 | 3UTR | 1285 | 1626 | ACUCAUUAGACUGGAACUUGAACUA | 30% |
| 14615 | 3UTR | 1286 | 1627 | CUCAUUAGACUGGAACUUGAACUGA | 43% |
| 14616 | 3UTR | 1287 | 1628 | UCAUUAGACUGGAACUUGAACUGAA | 26% |
| 14617 | 3UTR | 1291 | 1629 | UAGACUGGAACUUGAACUGAUUCAA | 33% |
| 14618 | 3UTR | 1293 | 1630 | GACUGGAACUUGAACUGAUUCACAA | 43% |
| 14619 | 3UTR | 1294 | 1631 | ACUGGAACUUGAACUGAUUCACAUA | 28% |
| 14620 | 3UTR | 1295 | 1632 | CUGGAACUUGAACUGAUUCACAUCA | 41% |
| 14621 | 3UTR | 1296 | 1633 | UGGAACUUGAACUGAUUCACAUCUA | 34% |
| 14622 | 3UTR | 1298 | 1634 | GAACUUGAACUGAUUCACAUCUCAA | 31% |
| 14623 | 3UTR | 1299 | 1635 | AACUUGAACUGAUUCACAUCUCAUA | 31% |
| 14624 | 3UTR | 1300 | 1636 | ACUUGAACUGAUUCACAUCUCAUUA | 33% |
| 14625 | 3UTR | 1301 | 1637 | CUUGAACUGAUUCACAUCUCAUUUA | 28% |
| 14626 | 3UTR | 1326 | 1638 | UCCGUAAAAUGAUUUCAGUAGCAA | 30% |
| 14627 | 3UTR | 1332 | 1639 | AAAUGAUUUCAGUAGCACAAGUUA | 28% |
| 14628 | 3UTR | 1395 | 1640 | CCCAAUUCAAAACAUUGUGCCAUGA | 63% |
| 14629 | 3UTR | 1397 | 1641 | CAAUUCAAAACAUUGUGCCAUGUCA | 39% |

TABLE 11-continued

Inhibition of gene expression with hCTGF ori sequences

| Target Duplex | Gene Name Region | Ref Pos | SEQ ID NO | CTGF Sense sequence | % Expression (0.1 nM) |
|---|---|---|---|---|---|
| 14630 | 3UTR | 1402 | 1642 | CAAAACAUUGUGCCAUGUCAAACAA | 34% |
| 14631 | 3UTR | 1408 | 1643 | AUUGUGCCAUGUCAAACAAAUAGUA | 33% |
| 14632 | 3UTR | 1409 | 1644 | UUGUGCCAUGUCAAACAAAUAGUCA | 33% |
| 14633 | 3UTR | 1412 | 1645 | UGCCAUGUCAAACAAAUAGUCUAUA | 36% |
| 14634 | 3UTR | 1416 | 1646 | AUGUCAAACAAAUAGUCUAUCAACA | 30% |
| 14635 | 3UTR | 1435 | 1647 | UCAACCCCAGACACUGGUUUGAAGA | 39% |
| 14636 | 3UTR | 1436 | 1648 | CAACCCCAGACACUGGUUUGAAGAA | 47% |
| 14637 | 3UTR | 1438 | 1649 | ACCCCAGACACUGGUUUGAAGAAUA | 45% |
| 14638 | 3UTR | 1439 | 1650 | CCCCAGACACUGGUUUGAAGAAUGA | 40% |
| 14639 | 3UTR | 1442 | 1651 | CAGACACUGGUUUGAAGAAUGUUAA | 21% |
| 14640 | 3UTR | 1449 | 1652 | UGGUUUGAAGAAUGUUAAGACUUGA | 22% |
| 14641 | 3UTR | 1453 | 1653 | UUGAAGAAUGUUAAGACUUGACAGA | 24% |
| 14642 | 3UTR | 1454 | 1654 | UGAAGAAUGUUAAGACUUGACAGUA | 37% |
| 14643 | 3UTR | 1462 | 1655 | GUUAAGACUUGACAGUGGAACUACA | 20% |
| 14644 | 3UTR | 1470 | 1656 | UUGACAGUGGAACUACAUUAGUACA | 30% |
| 14645 | 3UTR | 1471 | 1657 | UGACAGUGGAACUACAUUAGUACAA | 43% |
| 14646 | 3UTR | 1474 | 1658 | CAGUGGAACUACAUUAGUACACAGA | 36% |
| 14647 | 3UTR | 1475 | 1659 | AGUGGAACUACAUUAGUACACAGCA | 38% |
| 14648 | 3UTR | 1476 | 1660 | GUGGAACUACAUUAGUACACAGCAA | 35% |
| 14649 | 3UTR | 1477 | 1661 | UGGAACUACAUUAGUACACAGCACA | 34% |
| 14650 | 3UTR | 1478 | 1662 | GGAACUACAUUAGUACACAGCACCA | 33% |
| 14651 | 3UTR | 1479 | 1663 | GAACUACAUUAGUACACAGCACCAA | 39% |
| 14652 | 3UTR | 1480 | 1664 | AACUACAUUAGUACACAGCACCAGA | 27% |
| 14653 | 3UTR | 1481 | 1665 | ACUACAUUAGUACACAGCACCAGAA | 29% |
| 14654 | 3UTR | 1482 | 1666 | CUACAUUAGUACACAGCACCAGAAA | 38% |
| 14655 | 3UTR | 1483 | 1667 | UACAUUAGUACACAGCACCAGAAUA | 28% |
| 14656 | 3UTR | 1484 | 1668 | ACAUUAGUACACAGCACCAGAAUGA | 31% |
| 14657 | 3UTR | 1486 | 1669 | AUUAGUACACAGCACCAGAAUGUAA | 26% |
| 14658 | 3UTR | 1487 | 1670 | UUAGUACACAGCACCAGAAUGUAUA | 31% |
| 14659 | 3UTR | 1489 | 1671 | AGUACACAGCACCAGAAUGUAUAUA | 35% |
| 14660 | 3UTR | 1490 | 1672 | GUACACAGCACCAGAAUGUAUAUUA | 34% |
| 14661 | 3UTR | 1497 | 1673 | GCACCAGAAUGUAUAUUAAGGUGUA | 32% |
| 14662 | 3UTR | 1503 | 1674 | GAAUGUAUAUUAAGGUGUGGCUUUA | 42% |
| 14663 | 3UTR | 1539 | 1675 | AGGGUACCAGCAGAAAGGUUAGUAA | 28% |
| 14664 | 3UTR | 1543 | 1676 | UACCAGCAGAAAGGUUAGUAUCAUA | 29% |
| 14665 | 3UTR | 1544 | 1677 | ACCAGCAGAAAGGUUAGUAUCAUCA | 33% |
| 14666 | 3UTR | 1548 | 1678 | GCAGAAAGGUUAGUAUCAUCAGAUA | 34% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14667 | | 3UTR | 1557 | 1679 | UUAGUAUCAUCAGAUAGCAUCUUAA | 22% |
| 14668 | | 3UTR | 1576 | 1680 | UCUUAUACGAGUAAUAUGCCUGCUA | 48% |
| 14669 | | 3UTR | 1577 | 1681 | CUUAUACGAGUAAUAUGCCUGCUAA | 31% |
| 14670 | | 3UTR | 1579 | 1682 | UAUACGAGUAAUAUGCCUGCUAUUA | 43% |
| 14671 | | 3UTR | 1580 | 1683 | AUACGAGUAAUAUGCCUGCUAUUUA | 39% |
| 14672 | | 3UTR | 1581 | 1684 | UACGAGUAAUAUGCCUGCUAUUUGA | 33% |
| 14673 | | 3UTR | 1582 | 1685 | ACGAGUAAUAUGCCUGCUAUUUGAA | 40% |
| 14674 | | 3UTR | 1584 | 1686 | GAGUAAUAUGCCUGCUAUUUGAAGA | 38% |
| 14675 | | 3UTR | 1585 | 1687 | AGUAAUAUGCCUGCUAUUUGAAGUA | 24% |
| 14676 | | 3UTR | 1586 | 1688 | GUAAUAUGCCUGCUAUUUGAAGUGA | 34% |
| 14677 | | 3UTR | 1587 | 1689 | UAAUAUGCCUGCUAUUUGAAGUGUA | 26% |
| 14678 | | 3UTR | 1589 | 1690 | AUAUGCCUGCUAUUUGAAGUGUAAA | 26% |
| 14679 | | 3UTR | 1591 | 1691 | AUGCCUGCUAUUUGAAGUGUAAUUA | 25% |
| 14680 | | 3UTR | 1596 | 1692 | UGCUAUUUGAAGUGUAAUUGAGAAA | 36% |
| 14681 | | 3UTR | 1599 | 1693 | UAUUUGAAGUGUAAUUGAGAAGGAA | 22% |
| 14682 | | 3UTR | 1600 | 1694 | AUUUGAAGUGUAAUUGAGAAGGAAA | 22% |
| 14683 | | 3UTR | 1601 | 1695 | UUUGAAGUGUAAUUGAGAAGGAAAA | 19% |
| 14684 | | 3UTR | 1609 | 1696 | GUAAUUGAGAAGGAAAAUUUUAGCA | 53% |
| 14685 | | 3UTR | 1610 | 1697 | UAAUUGAGAAGGAAAAUUUUAGCGA | 55% |
| 14686 | | 3UTR | 1611 | 1698 | AAUUGAGAAGGAAAAUUUUAGCGUA | 20% |
| 14687 | | 3UTR | 1612 | 1699 | AUUGAGAAGGAAAAUUUUAGCGUGA | 23% |
| 14688 | | 3UTR | 1613 | 1700 | UUGAGAAGGAAAAUUUUAGCGUGCA | 37% |
| 14689 | | 3UTR | 1614 | 1701 | UGAGAAGGAAAAUUUUAGCGUGCUA | 31% |
| 14690 | | 3UTR | 1619 | 1702 | AGGAAAAUUUUAGCGUGCUCACUGA | 46% |
| 14691 | | 3UTR | 1657 | 1703 | CCAGUGACAGCUAGGAUGUGCAUUA | 42% |
| 14692 | | 3UTR | 1661 | 1704 | UGACAGCUAGGAUGUGCAUUCUCCA | 39% |
| 14693 | | 3UTR | 1682 | 1705 | UCCAGCCAUCAAGAGACUGAGUCAA | 53% |
| 14694 | | 3UTR | 1685 | 1706 | AGCCAUCAAGAGACUGAGUCAAGUA | 71% |
| 14695 | | 3UTR | 1686 | 1707 | GCCAUCAAGAGACUGAGUCAAGUUA | 54% |
| 14696 | | 3UTR | 1687 | 1708 | CCAUCAAGAGACUGAGUCAAGUUGA | 71% |
| 14697 | | 3UTR | 1688 | 1709 | CAUCAAGAGACUGAGUCAAGUUGUA | 74% |
| 14698 | | 3UTR | 1689 | 1710 | AUCAAGAGACUGAGUCAAGUUGUUA | 61% |
| 14699 | | 3UTR | 1690 | 1711 | UCAAGAGACUGAGUCAAGUUGUUCA | 59% |
| 14700 | | 3UTR | 1691 | 1712 | CAAGAGACUGAGUCAAGUUGUUCCA | 73% |
| 14701 | | 3UTR | 1692 | 1713 | AAGAGACUGAGUCAAGUUGUUCCUA | 78% |
| 14702 | | 3UTR | 1693 | 1714 | AGAGACUGAGUCAAGUUGUUCCUUA | 60% |
| 14703 | | 3UTR | 1695 | 1715 | AGACUGAGUCAAGUUGUUCCUUAAA | 63% |
| 14704 | | 3UTR | 1696 | 1716 | GACUGAGUCAAGUUGUUCCUUAAGA | 92% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14705 | | 3UTR | 1697 | 1717 | ACUGAGUCAAGUUGUUCCUUAAGUA | 74% |
| 14706 | | 3UTR | 1707 | 1718 | GUUGUUCCUUAAGUCAGAACAGCAA | 70% |
| 14707 | | 3UTR | 1724 | 1719 | AACAGCAGACUCAGCUCUGACAUUA | 69% |
| 14708 | | 3UTR | 1725 | 1720 | ACAGCAGACUCAGCUCUGACAUUCA | 67% |
| 14709 | | 3UTR | 1726 | 1721 | CAGCAGACUCAGCUCUGACAUUCUA | 71% |
| 14710 | | 3UTR | 1727 | 1722 | AGCAGACUCAGCUCUGACAUUCUGA | 73% |
| 14711 | | 3UTR | 1728 | 1723 | GCAGACUCAGCUCUGACAUUCUGAA | 60% |
| 14712 | | 3UTR | 1729 | 1724 | CAGACUCAGCUCUGACAUUCUGAUA | 72% |
| 14713 | | 3UTR | 1732 | 1725 | ACUCAGCUCUGACAUUCUGAUUCGA | 24% |
| 14714 | | 3UTR | 1733 | 1726 | CUCAGCUCUGACAUUCUGAUUCGAA | 32% |
| 14715 | | 3UTR | 1734 | 1727 | UCAGCUCUGACAUUCUGAUUCGAAA | 23% |
| 14716 | | 3UTR | 1735 | 1728 | CAGCUCUGACAUUCUGAUUCGAAUA | 27% |
| 14717 | | 3UTR | 1736 | 1729 | AGCUCUGACAUUCUGAUUCGAAUGA | 38% |
| 14718 | | 3UTR | 1739 | 1730 | UCUGACAUUCUGAUUCGAAUGACAA | 28% |
| 14719 | | 3UTR | 1741 | 1731 | UGACAUUCUGAUUCGAAUGACACUA | 29% |
| 14720 | | 3UTR | 1742 | 1732 | GACAUUCUGAUUCGAAUGACACUGA | 33% |
| 14721 | | 3UTR | 1743 | 1733 | ACAUUCUGAUUCGAAUGACACUGUA | 28% |
| 14722 | | 3UTR | 1747 | 1734 | UCUGAUUCGAAUGACACUGUUCAGA | 39% |
| 14723 | | 3UTR | 1748 | 1735 | CUGAUUCGAAUGACACUGUUCAGGA | 36% |
| 14724 | | 3UTR | 1750 | 1736 | GAUUCGAAUGACACUGUUCAGGAAA | 33% |
| 14725 | | 3UTR | 1751 | 1737 | AUUCGAAUGACACUGUUCAGGAAUA | 30% |
| 14726 | | 3UTR | 1759 | 1738 | GACACUGUUCAGGAAUCGGAAUCCA | 34% |
| 14727 | | 3UTR | 1760 | 1739 | ACACUGUUCAGGAAUCGGAAUCCUA | 35% |
| 14728 | | 3UTR | 1761 | 1740 | CACUGUUCAGGAAUCGGAAUCCUGA | 40% |
| 14729 | | 3UTR | 1768 | 1741 | CAGGAAUCGGAAUCCUGUCGAUUAA | 34% |
| 14730 | | 3UTR | 1769 | 1742 | AGGAAUCGGAAUCCUGUCGAUUAGA | 31% |
| 14731 | | 3UTR | 1770 | 1743 | GGAAUCGGAAUCCUGUCGAUUAGAA | 24% |
| 14732 | | 3UTR | 1771 | 1744 | GAAUCGGAAUCCUGUCGAUUAGACA | 32% |
| 14733 | | 3UTR | 1772 | 1745 | AAUCGGAAUCCUGUCGAUUAGACUA | 29% |
| 14734 | | 3UTR | 1774 | 1746 | UCGGAAUCCUGUCGAUUAGACUGGA | 34% |
| 14735 | | 3UTR | 1777 | 1747 | GAAUCCUGUCGAUUAGACUGGACAA | 51% |
| 14736 | | 3UTR | 1782 | 1748 | CUGUCGAUUAGACUGGACAGCUUGA | 88% |
| 14737 | | 3UTR | 1783 | 1749 | UGUCGAUUAGACUGGACAGCUUGUA | 38% |
| 14738 | | 3UTR | 1797 | 1750 | GACAGCUUGUGGCAAGUGAAUUUGA | 46% |
| 14739 | | 3UTR | 1798 | 1751 | ACAGCUUGUGGCAAGUGAAUUUGCA | 52% |
| 14740 | | 3UTR | 1800 | 1752 | AGCUUGUGGCAAGUGAAUUUGCCUA | 43% |
| 14741 | | 3UTR | 1801 | 1753 | GCUUGUGGCAAGUGAAUUUGCCUGA | 51% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14742 | 3UTR | 1802 | 1754 | CUUGUGGCAAGUGAAUUUGCCUGUA | 32% |
| 14743 | 3UTR | 1803 | 1755 | UUGUGGCAAGUGAAUUUGCCUGUAA | 31% |
| 14744 | 3UTR | 1804 | 1756 | UGUGGCAAGUGAAUUUGCCUGUAAA | 29% |
| 14745 | 3UTR | 1805 | 1757 | GUGGCAAGUGAAUUUGCCUGUAACA | 20% |
| 14746 | 3UTR | 1806 | 1758 | UGGCAAGUGAAUUUGCCUGUAACAA | 34% |
| 14747 | 3UTR | 1807 | 1759 | GGCAAGUGAAUUUGCCUGUAACAAA | 31% |
| 14748 | 3UTR | 1808 | 1760 | GCAAGUGAAUUUGCCUGUAACAAGA | 27% |
| 14749 | 3UTR | 1809 | 1761 | CAAGUGAAUUUGCCUGUAACAAGCA | 34% |
| 14750 | 3UTR | 1810 | 1762 | AAGUGAAUUUGCCUGUAACAAGCCA | 36% |
| 14751 | 3UTR | 1811 | 1763 | AGUGAAUUUGCCUGUAACAAGCCAA | 31% |
| 14752 | 3UTR | 1814 | 1764 | GAAUUUGCCUGUAACAAGCCAGAUA | 24% |
| 14753 | 3UTR | 1815 | 1765 | AAUUUGCCUGUAACAAGCCAGAUUA | 21% |
| 14754 | 3UTR | 1816 | 1766 | AUUUGCCUGUAACAAGCCAGAUUUA | 22% |
| 14755 | 3UTR | 1910 | 1767 | AAGUUAAUUUAAAGUUGUUUGUGCA | 58% |
| 14756 | 3UTR | 1911 | 1768 | AGUUAAUUUAAAGUUGUUUGUGCCA | 73% |
| 14757 | 3UTR | 1912 | 1769 | GUUAAUUUAAAGUUGUUUGUGCCUA | 64% |
| 14758 | 3UTR | 1957 | 1770 | UUUGAUAUUUCAAUGUUAGCCUCAA | 42% |
| 14759 | 3UTR | 1961 | 1771 | AUAUUUCAAUGUUAGCCUCAAUUUA | 30% |
| 14760 | 3UTR | 1971 | 1772 | GUUAGCCUCAAUUUCUGAACACCAA | 34% |
| 14761 | 3UTR | 1974 | 1773 | AGCCUCAAUUUCUGAACACCAUAGA | 35% |
| 14762 | 3UTR | 1975 | 1774 | GCCUCAAUUUCUGAACACCAUAGGA | 33% |
| 14763 | 3UTR | 1976 | 1775 | CCUCAAUUUCUGAACACCAUAGGUA | 39% |
| 14764 | 3UTR | 1977 | 1776 | CUCAAUUUCUGAACACCAUAGGUAA | 27% |
| 14765 | 3UTR | 1978 | 1777 | UCAAUUUCUGAACACCAUAGGUAGA | 31% |
| 14766 | 3UTR | 1979 | 1778 | CAAUUUCUGAACACCAUAGGUAGAA | 49% |
| 14767 | 3UTR | 1980 | 1779 | AAUUUCUGAACACCAUAGGUAGAAA | 46% |
| 14768 | 3UTR | 1981 | 1780 | AUUUCUGAACACCAUAGGUAGAAUA | 40% |
| 14769 | 3UTR | 1982 | 1781 | UUUCUGAACACCAUAGGUAGAAUGA | 47% |
| 14770 | 3UTR | 1985 | 1782 | CUGAACACCAUAGGUAGAAUGUAAA | 33% |
| 14771 | 3UTR | 1986 | 1783 | UGAACACCAUAGGUAGAAUGUAAAA | 35% |
| 14772 | 3UTR | 1987 | 1784 | GAACACCAUAGGUAGAAUGUAAAGA | 31% |
| 14773 | 3UTR | 1988 | 1785 | AACACCAUAGGUAGAAUGUAAAGCA | 30% |
| 14774 | 3UTR | 1989 | 1786 | ACACCAUAGGUAGAAUGUAAAGCUA | 32% |
| 14775 | 3UTR | 1991 | 1787 | ACCAUAGGUAGAAUGUAAAGCUUGA | 31% |
| 14776 | 3UTR | 1992 | 1788 | CCAUAGGUAGAAUGUAAAGCUUGUA | 34% |
| 14777 | 3UTR | 1993 | 1789 | CAUAGGUAGAAUGUAAAGCUUGUCA | 31% |
| 14778 | 3UTR | 1994 | 1790 | AUAGGUAGAAUGUAAAGCUUGUCUA | 28% |
| 14779 | 3UTR | 1996 | 1791 | AGGUAGAAUGUAAAGCUUGUCUGAA | 32% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14780 | | 3UTR | 2002 | 1792 | AAUGUAAAGCUUGUCUGAUCGUUCA | 34% |
| 14781 | | 3UTR | 2017 | 1793 | UGAUCGUUCAAAGCAUGAAAUGGAA | 31% |
| 14782 | | 3UTR | 2021 | 1794 | CGUUCAAAGCAUGAAAUGGAUACUA | 39% |
| 14783 | | 3UTR | 2022 | 1795 | GUUCAAAGCAUGAAAUGGAUACUUA | 25% |
| 14784 | | 3UTR | 2023 | 1796 | UUCAAAGCAUGAAAUGGAUACUUAA | 22% |
| 14785 | | 3UTR | 2047 | 1797 | UAUGGAAAUUCUGCUCAGAUAGAAA | 39% |
| 14786 | | 3UTR | 2048 | 1798 | AUGGAAAUUCUGCUCAGAUAGAAUA | 35% |
| 14787 | | 3UTR | 2059 | 1799 | GCUCAGAUAGAAUGACAGUCCGUCA | 44% |
| 14788 | | 3UTR | 2060 | 1800 | CUCAGAUAGAAUGACAGUCCGUCAA | 41% |
| 14789 | | 3UTR | 2062 | 1801 | CAGAUAGAAUGACAGUCCGUCAAAA | 46% |
| 14790 | | 3UTR | 2063 | 1802 | AGAUAGAAUGACAGUCCGUCAAAAA | 45% |
| 14791 | | 3UTR | 2065 | 1803 | AUAGAAUGACAGUCCGUCAAAACAA | 41% |
| 14792 | | 3UTR | 2067 | 1804 | AGAAUGACAGUCCGUCAAAACAGAA | 36% |
| 14793 | | 3UTR | 2068 | 1805 | GAAUGACAGUCCGUCAAAACAGAUA | 40% |
| 14794 | | 3UTR | 2113 | 1806 | AGUGUCCUUGGCAGGCUGAUUUCUA | 42% |
| 14795 | | 3UTR | 2114 | 1807 | GUGUCCUUGGCAGGCUGAUUUCUAA | 42% |
| 14796 | | 3UTR | 2118 | 1808 | CCUUGGCAGGCUGAUUUCUAGGUAA | 111% |
| 14797 | | 3UTR | 2127 | 1809 | GCUGAUUUCUAGGUAGGAAAUGUGA | 44% |
| 14798 | | 3UTR | 2128 | 1810 | CUGAUUUCUAGGUAGGAAAUGUGGA | 44% |
| 14799 | | 3UTR | 2130 | 1811 | GAUUUCUAGGUAGGAAAUGUGGUAA | 46% |
| 14800 | | 3UTR | 2131 | 1812 | AUUUCUAGGUAGGAAAUGUGGUAGA | 45% |
| 14801 | | 3UTR | 2142 | 1813 | GGAAAUGUGGUAGCCUCACUUUUAA | 37% |
| 14802 | | 3UTR | 2146 | 1814 | AUGUGGUAGCCUCACUUUUAAUGAA | 39% |
| 14803 | | 3UTR | 2149 | 1815 | UGGUAGCCUCACUUUUAAUGAACAA | 40% |
| 14804 | | 3UTR | 2154 | 1816 | GCCUCACUUUUAAUGAACAAAUGGA | 35% |
| 14805 | | 3UTR | 2155 | 1817 | CCUCACUUUUAAUGAACAAAUGGCA | 41% |
| 14806 | | 3UTR | 2181 | 1818 | UUAUUAAAAACUGAGUGACUCUAUA | 26% |
| 14807 | | 3UTR | 2182 | 1819 | UAUUAAAAACUGAGUGACUCUAUAA | 29% |
| 14808 | | 3UTR | 2183 | 1820 | AUUAAAAACUGAGUGACUCUAUAUA | 28% |
| 14809 | | 3UTR | 2186 | 1821 | AAAAACUGAGUGACUCUAUAUAGCA | 31% |
| 14810 | | 3UTR | 2187 | 1822 | AAAACUGAGUGACUCUAUAUAGCUA | 28% |
| 14811 | | 3UTR | 2188 | 1823 | AAACUGAGUGACUCUAUAUAGCUGA | 38% |
| 14812 | | 3UTR | 2189 | 1824 | AACUGAGUGACUCUAUAUAGCUGAA | 44% |
| 14813 | | 3UTR | 2190 | 1825 | ACUGAGUGACUCUAUAUAGCUGAUA | 38% |
| 14814 | | 3UTR | 2255 | 1826 | ACUGUUUUCGGACAGUUUAUUUGA | 29% |
| 14815 | | 3UTR | 2256 | 1827 | CUGUUUUCGGACAGUUUAUUUGUA | 25% |
| 14816 | | 3UTR | 2263 | 1828 | UCGGACAGUUUAUUUGUUGAGAGUA | 29% |

TABLE 11-continued

Inhibition of gene expression with hCTGF ori sequences

| Target Duplex | Gene Name | Gene Region | Ref Pos | SEQ ID NO | CTGF Sense sequence | % Expression (0.1 nM) |
|---|---|---|---|---|---|---|
| 14817 | | 3UTR | 2265 | 1829 | GGACAGUUUAUUUGUUGAGAGUGUA | 24% |
| 14818 | | 3UTR | 2268 | 1830 | CAGUUUAUUUGUUGAGAGUGUGACA | 26% |
| 14819 | | 3UTR | 2269 | 1831 | AGUUUAUUUGUUGAGAGUGUGACCA | 37% |
| 14820 | | 3UTR | 2272 | 1832 | UUAUUUGUUGAGAGUGUGACCAAAA | 27% |
| 14821 | | 3UTR | 2273 | 1833 | UAUUUGUUGAGAGUGUGACCAAAAA | 30% |
| 14822 | | 3UTR | 2274 | 1834 | AUUUGUUGAGAGUGUGACCAAAAGA | 26% |
| 14823 | | 3UTR | 2275 | 1835 | UUUGUUGAGAGUGUGACCAAAAGUA | 27% |
| 14824 | | 3UTR | 2276 | 1836 | UUGUUGAGAGUGUGACCAAAAGUUA | 30% |
| 14825 | | 3UTR | 2277 | 1837 | UGUUGAGAGUGUGACCAAAAGUUAA | 29% |
| 14826 | | 3UTR | 2278 | 1838 | GUUGAGAGUGUGACCAAAAGUUACA | 33% |
| 14827 | | 3UTR | 2279 | 1839 | UUGAGAGUGUGACCAAAAGUUACAA | 35% |
| 14828 | | 3UTR | 2281 | 1840 | GAGAGUGUGACCAAAAGUUACAUGA | 36% |
| 14829 | | 3UTR | 2282 | 1841 | AGAGUGUGACCAAAAGUUACAUGUA | 36% |
| 14830 | | 3UTR | 2283 | 1842 | GAGUGUGACCAAAAGUUACAUGUUA | 33% |
| 14831 | | 3UTR | 2284 | 1843 | AGUGUGACCAAAAGUUACAUGUUUA | 31% |
| 14832 | | 3UTR | 2285 | 1844 | GUGUGACCAAAAGUUACAUGUUUGA | 22% |
| 14833 | | 3UTR | 2286 | 1845 | UGUGACCAAAAGUUACAUGUUUGCA | 40% |
| 14834 | | 3UTR | 2293 | 1846 | AAAAGUUACAUGUUUGCACCUUUCA | 24% |
| 14835 | | 3UTR | 2295 | 1847 | AAGUUACAUGUUUGCACCUUUCUAA | 23% |
| 14836 | | 3UTR | 2296 | 1848 | AGUUACAUGUUUGCACCUUUCUAGA | 29% |
| 14837 | | 3UTR | 2299 | 1849 | UACAUGUUUGCACCUUUCUAGUUGA | 27% |
| 14838 | | 3UTR | 2300 | 1850 | ACAUGUUUGCACCUUUCUAGUUGAA | 29% |
| 14839 | | 3UTR | 2301 | 1851 | CAUGUUUGCACCUUUCUAGUUGAAA | 35% |

Key:

| PS | * | = Phosphothioate Backbone Linkage |
| RNA | G | = Guanine |
| RNA | U | = Uracil |
| RNA | C | = Cytosine |

-continued

Key:

| RNA | A | = Adenine |
| | m | 2' Omethyl |
| | f | 2'-Fluoro |
| Phosphate | P | 5' Phosphate |

TABLE 12

Inhibition of gene expression with CTGF ori sequences (Accession Number: NM_001901.2)

| Oligo ID | Gene Region | Ref Pos | SEQ ID NO | 25-mer Sense Strand (position 25 of SS, replaced with A) 25-mer Sense Strand (position 25 of SS, original base, not replaced by A) | A549 0.1 nM Activity |
|---|---|---|---|---|---|
| 13843 | CDS | 1047 | 1852 | UACCGAGCUAAAUUCUGUGGAGUAU | 113% |
| 13844 | 3UTR | 2164 | 1853 | UAAUGAACAAAUGGCCUUUAUUAAA | 61% |
| 13845 | 3UTR | 1795 | 1854 | UGGACAGCUUGUGGCAAGUGAAUUU | 99% |

TABLE 12-continued

Inhibition of gene expression with CTGF ori sequences (Accession Number: NM_001901.2)

| Oligo ID | Gene Region | Ref Pos | SEQ ID NO | 25-mer Sense Strand (position 25 of SS, original base, not replaced by A) / 25-mer Sense Strand (position 25 of SS, replaced with A) | A549 0.1 nM Activity |
|---|---|---|---|---|---|
| 13846 | CDS | 1228 | 1855 | UGUACUACAGGAAGAUGUACGGAGA | 87% |
| 13847 | CDS | 1146 | 1856 | GUCAUGAAGAAGAACAUGAUGUUCA | 98% |
| 13848 | CDS | 1150 | 1857 | UGAAGAAGAACAUGAUGUUCAUCAA | 105% |
| 13849 | CDS | 1218 | 1858 | UUUGAAUCGCUGUACUACAGGAAGA | 91% |
| 13850 | 3UTR | 2262 | 1859 | UUCGGACAGUUUAUUUGUUGAGAGU | 50% |
| 13851 | CDS | 1147 | 1860 | UCAUGAAGAAGAACAUGAUGUUCAU | 104% |
| 13852 | 3UTR | 2163 | 1861 | UUAAUGAACAAAUGGCCUUUAUUAA | 54% |
| 13853 | 3UTR | 1414 | 1862 | CCAUGUCAAACAAAUAGUCUAUCAA | 35% |
| 13854 | CDS | 1195 | 1863 | ACUGUCCCGGAGACAAUGACAUCUU | 103% |
| 13855 | 3UTR | 1788 | 1864 | AUUAGACUGGACAGCUUGUGGCAAG | 103% |
| 13856 | 3UTR | 1793 | 1865 | ACUGGACAGCUUGUGGCAAGUGAAU | 81% |
| 13857 | 3UTR | 1891 | 1866 | UAUAUAUGUACAGUUAUCUAAGUUA | 73% |
| 13858 | 3UTR | 2270 | 1867 | GUUUAUUUGUUGAGAGUGUGACCAA | 76% |
| 13859 |  | 482 | 1868 | CAAGAUCGGCGUGUGCACCGCCAAA | 95% |
| 13860 | CDS | 942 | 1869 | GCUGACCUGGAAGAGAACAUUAAGA | 93% |
| 13861 | CDS | 1199 | 1870 | UCCCGGAGACAAUGACAUCUUUGAA | 83% |
| 13862 | 3UTR | 2258 | 1871 | GUUUUUCGGACAGUUUAUUUGUUGA | 40% |
| 13863 | CDS | 1201 | 1872 | CCGGAGACAAUGACAUCUUUGAAUC | 123% |
| 13864 | CDS | 543 | 1873 | CGCAGCGGAGAGUCCUUCCAGAGCA | 124% |
| 13865 | 3UTR | 1496 | 1874 | AGCACCAGAAUGUAUAUUAAGGUGU | 109% |
| 13866 | CDS | 793 | 1875 | UGAUUAGAGCCAACUGCCUGGUCCA | 125% |
| 13867 | CDS | 1198 | 1876 | GUCCCGGAGACAAUGACAUCUUUGA | 64% |
| 13868 | 3UTR | 2160 | 1877 | CUUUUAAUGAACAAAUGGCCUUUAU | 68% |
| 13869 | CDS | 1149 | 1878 | AUGAAGAAGAACAUGAUGUUCAUCA | 107% |
| 13870 | CDS | 1244 | 1879 | GUACGGAGACAUGGCAUGAAGCCAG | 107% |
| 13871 | 3UTR | 1495 | 1880 | CAGCACCAGAAUGUAUAUUAAGGUG | 77% |
| 13872 |  | 475 | 1881 | CCAACCGCAAGAUCGGCGUGUGCAC | 113% |
| 13873 | CDS | 806 | 1882 | CUGCCUGGUCCAGACCACAGAGUGG | 113% |
| 13874 | CDS | 819 | 1883 | ACCACAGAGUGGAGCGCCUGUUCCA | 99% |
| 13875 | CDS | 1221 | 1884 | GAAUCGCUGUACUACAGGAAGAUGU | 97% |
| 13876 | CDS | 1152 | 1885 | AAGAAGAACAUGAUGUUCAUCAAGA | 121% |
| 13877 | CDS | 1163 | 1886 | GAUGUUCAUCAAGACCUGUGCCUGC | 125% |
| 13878 | 3UTR | 1494 | 1887 | ACAGCACCAGAAUGUAUAUUAAGGU | 94% |
| 13879 | 3UTR | 1890 | 1888 | AUAUAUAUGUACAGUUAUCUAAGUU | 94% |
| 13880 |  | 473 | 1889 | GGCCAACCGCAAGAUCGGCGUGUGC | 122% |
| 13881 |  | 544 | 1890 | GCAGCGGAGAGUCCUUCCAGAGCAG | 111% |

TABLE 12-continued

Inhibition of gene expression with CTGF ori sequences (Accession Number: NM_001901.2)

| Oligo ID | Gene Region | Ref Pos | SEQ ID NO | 25-mer Sense Strand (position 25 of SS, original base, not replaced by A) / 25-mer Sense Strand (position 25 of SS, replaced with A) | A549 0.1 nM Activity |
|---|---|---|---|---|---|
| 13882 | CDS | 883 | 1891 | ACAACGCCUCCUGCAGGCUAGAGAA | 105% |
| 13883 | CDS | 1240 | 1892 | AGAUGUACGGAGACAUGGCAUGAAG | 99% |
| 13884 | CDS | 1243 | 1893 | UGUACGGAGACAUGGCAUGAAGCCA | 116% |
| 13885 | 3UTR | 2266 | 1894 | GACAGUUUAUUGUUGAGAGUGUGA | 53% |
| 13886 | CDS | 1011 | 1895 | AAGUUUGAGCUUUCUGGCUGCACCA | 118% |
| 13887 | CDS | 1020 | 1896 | CUUUCUGGCUGCACCAGCAUGAAGA | 110% |
| 13888 | CDS | 1168 | 1897 | UCAUCAAGACCUGUGCCUGCCAUUA | 119% |
| 13889 | | 1415 | 1898 | CAUGUCAAACAAAUAGUCUAUCAAC | 64% |
| 13890 | 3UTR | 1792 | 1899 | GACUGGACAGCUUGUGGCAAGUGAA | 53% |
| 13891 | 3UTR | 2156 | 1900 | CUCACUUUUAAUGAACAAAUGGCCU | 119% |
| 13892 | | 379 | 1901 | GCUGCCGCGUCUGCGCCAAGCAGCU | 112% |
| 13893 | CDS | 1229 | 1902 | GUACUACAGGAAGAUGUACGGAGAC | 112% |
| 13894 | 3UTR | 1791 | 1903 | AGACUGGACAGCUUGUGGCAAGUGA | 65% |
| 13895 | 3UTR | 2158 | 1904 | CACUUUUAAUGAACAAAUGGCCUUU | 76% |
| 13896 | | 488 | 1905 | CGGCGUGUGCACCGCCAAAGAUGGU | 89% |
| 13897 | CDS | 1151 | 1906 | GAAGAAGAACAUGAUGUUCAUCAAG | 119% |
| 13898 | CDS | 1156 | 1907 | AGAACAUGAUGUUCAUCAAGACCUG | 125% |
| 13899 | CDS | 1237 | 1908 | GGAAGAUGUACGGAGACAUGGCAUG | 114% |
| 13900 | CDS | 1202 | 1909 | CGGAGACAAUGACAUCUUUGAAUCG | 130% |
| 13901 | CDS | 1236 | 1910 | AGGAAGAUGUACGGAGACAUGGCAU | 135% |
| 13902 | 3UTR | 1786 | 1911 | CGAUUAGACUGGACAGCUUGUGGCA | 119% |
| 13903 | 3UTR | 1789 | 1912 | UUAGACUGGACAGCUUGUGGCAAGU | 108% |
| 13904 | 3UTR | 2290 | 1913 | ACCAAAAGUUACAUGUUUGCACCUU | 90% |
| 13905 | CDS | 1017 | 1914 | GAGCUUUCUGGCUGCACCAGCAUGA | 121% |
| 13906 | CDS | 1197 | 1915 | UGUCCCGGAGACAAUGACAUCUUUG | 125% |
| 13907 | CDS | 1219 | 1916 | UUGAAUCGCUGUACUACAGGAAGAU | 98% |
| 13908 | 3UTR | 2159 | 1917 | ACUUUUAAUGAACAAAUGGCCUUUA | 52% |
| 13909 | | 486 | 1918 | AUCGGCGUGUGCACCGCCAAAGAUG | 119% |
| 13910 | CDS | 826 | 1919 | AGUGGAGCGCCUGUUCCAAGACCUG | 139% |
| 13911 | CDS | 1022 | 1920 | UUCUGGCUGCACCAGCAUGAAGACA | 144% |
| 13912 | 3UTR | 1492 | 1921 | ACACAGCACCAGAAUGUAUAUUAAG | 99% |
| 13913 | 3UTR | 1781 | 1922 | CCUGUCGAUUAGACUGGACAGCUUG | 89% |
| 13914 | | 485 | 1923 | GAUCGGCGUGUGCACCGCCAAAGAU | 131% |
| 13915 | CDS | 1007 | 1924 | UAUCAAGUUUGAGCUUUCUGGCUGC | 92% |
| 13916 | CDS | 1242 | 1925 | AUGUACGGAGACAUGGCAUGAAGCC | 106% |
| 13917 | 3UTR | 1787 | 1926 | GAUUAGACUGGACAGCUUGUGGCAA | 104% |

TABLE 12-continued

Inhibition of gene expression with CTGF ori sequences (Accession Number: NM_001901.2)

| Oligo ID | Gene Region | Ref Pos | SEQ ID NO | 25-mer Sense Strand (position 25 of SS, original base, not replaced by A) 25-mer Sense Strand (position 25 of SS, replaced with A) | A549 0.1 nM Activity |
|---|---|---|---|---|---|
| 13918 | 3UTR | 1889 | 1927 | UAUAUAUAUGUACAGUUAUCUAAGU | 78% |
| 13919 | 3UTR | 2294 | 1928 | AAAGUUACAUGUUUGCACCUUUCUA | 28% |
| 13920 | CDS | 821 | 1929 | CACAGAGUGGAGCGCCUGUUCCAAG | 108% |
| 13921 | CDS | 884 | 1930 | CAACGCCUCCUGCAGGCUAGAGAAG | 125% |
| 13922 | 3UTR | 2260 | 1931 | UUUUCGGACAGUUUAUUUGUUGAGA | 43% |
| 13923 | CDS | 889 | 1932 | CCUCCUGCAGGCUAGAGAAGCAGAG | 95% |
| 13924 | CDS | 1226 | 1933 | GCUGUACUACAGGAAGAUGUACGGA | 122% |
| 13925 | 3UTR | 1493 | 1934 | CACAGCACCAGAAUGUAUAUUAAGG | 88% |
| 13926 | 3UTR | 1799 | 1935 | CAGCUUGUGGCAAGUGAAUUUGCCU | 89% |
| 13927 | CDS | 807 | 1936 | UGCCUGGUCCAGACCACAGAGUGGA | 101% |
| 13928 | CDS | 1107 | 1937 | ACCACCCUGCCGGUGGAGUUCAAGU | 113% |
| 13929 | CDS | 1155 | 1938 | AAGAACAUGAUGUUCAUCAAGACCU | 109% |
| 13930 | CDS | 1169 | 1939 | CAUCAAGACCUGUGCCUGCCAUUAC | 89% |
| 13931 | CDS | 1241 | 1940 | GAUGUACGGAGACAUGGCAUGAAGC | 96% |
| 13932 | 3UTR | 1794 | 1941 | CUGGACAGCUUGUGGCAAGUGAAUU | 73% |
| 13933 | 3UTR | 1888 | 1942 | AUAUAUAUAUGUACAGUUAUCUAAG | 98% |
| 13934 | 3UTR | 2289 | 1943 | GACCAAAAGUUACAUGUUUGCACCU | 77% |
| 13935 | | 373 | 1944 | GCGGCUGCUGCCGCGUCUGCGCCAA | 85% |
| 13936 | CDS | 799 | 1945 | GAGCCAACUGCCUGGUCCAGACCAC | 126% |
| 13937 | CDS | 802 | 1946 | CCAACUGCCUGGUCCAGACCACAGA | 122% |
| 13938 | CDS | 1166 | 1947 | GUUCAUCAAGACCUGUGCCUGCCAU | 106% |

TABLE 13

Inhibition of gene expression with SPP1 sd-rxRNA sequences (Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14084 | 1025 | 1948 | CUCAUGAAUUAGA | 1949 | UCUAAUUCAUGAGAAAUAC | 61% |
| 14085 | 1049 | 1950 | CUGAGGUCAAUUA | 1951 | UAAUUGACCUCAGAAGAUG | 50% |
| 14086 | 1051 | 1952 | GAGGUCAAUUAAA | 1953 | UUUAAUUGACCUCAGAAGA | n/a |
| 14087 | 1048 | 1954 | UCUGAGGUCAAUU | 1955 | AAUUGACCUCAGAAGAUGC | 69% |
| 14088 | 1050 | 1956 | UGAGGUCAAUUAA | 1957 | UUAAUUGACCUCAGAAGAU | 76% |
| 14089 | 1047 | 1958 | UUCUGAGGUCAAU | 1959 | AUUGACCUCAGAAGAUGCA | 60% |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14090 | 800 | 1960 | GUCAGCUGGAUGA | 1961 | UCAUCCAGCUGACUCGUUU | 71% |
| 14091 | 492 | 1962 | UUCUGAUGAAUCU | 1963 | AGAUUCAUCAGAAUGGUGA | n/a |
| 14092 | 612 | 1964 | UGGACUGAGGUCA | 1965 | UGACCUCAGUCCAUAAACC | n/a |
| 14093 | 481 | 1966 | GAGUCUCACCAUU | 1967 | AAUGGUGAGACUCAUCAGA | n/a |
| 14094 | 614 | 1968 | GACUGAGGUCAAA | 1969 | UUUGACCUCAGUCCAUAAA | n/a |
| 14095 | 951 | 1970 | UCACAGCCAUGAA | 1971 | UUCAUGGCUGUGAAAUUCA | 89% |
| 14096 | 482 | 1972 | AGUCUCACCAUUC | 1973 | GAAUGGUGAGACUCAUCAG | 87% |
| 14097 | 856 | 1974 | AAGCGGAAAGCCA | 1975 | UGGCUUUCCGCUUAUAUAA | 88% |
| 14098 | 857 | 1976 | AGCGGAAAGCCAA | 1977 | UUGGCUUUCCGCUUAUAUA | 113% |
| 14099 | 365 | 1978 | ACCACAUGGAUGA | 1979 | UCAUCCAUGUGGUCAUGGC | 98% |
| 14100 | 359 | 1980 | GCCAUGACCACAU | 1981 | AUGUGGUCAUGGCUUUCGU | 84% |
| 14101 | 357 | 1982 | AAGCCAUGACCAC | 1983 | GUGGUCAUGGCUUUCGUUG | 88% |
| 14102 | 858 | 1984 | GCGGAAAGCCAAU | 1985 | AUUGGCUUUCCGCUUAUAU | n/a |
| 14103 | 1012 | 1986 | AAAUUUCGUAUUU | 1987 | AAAUACGAAAUUUCAGGUG | 93% |
| 14104 | 1014 | 1988 | AUUUCGUAUUUCU | 1989 | AGAAAUACGAAAUUUCAGG | 89% |
| 14105 | 356 | 1990 | AAAGCCAUGACCA | 1991 | UGGUCAUGGCUUUCGUUGG | 85% |
| 14106 | 368 | 1992 | ACAUGGAUGAUAU | 1993 | AUAUCAUCCAUGUGGUCAU | 67% |
| 14107 | 1011 | 1994 | GAAAUUUCGUAUU | 1995 | AAUACGAAAUUUCAGGUGU | 87% |
| 14108 | 754 | 1996 | GCGCCUUCUGAUU | 1997 | AAUCAGAAGGCGCGUUCAG | 73% |
| 14109 | 1021 | 1998 | AUUUCUCAUGAAU | 1999 | AUUCAUGAGAAAUACGAAA | 128% |
| 14110 | 1330 | 2000 | CUCUCAUGAAUAG | 2001 | CUAUUCAUGAGAAUAAC | 101% |
| 14111 | 346 | 2002 | AAGUCCAACGAAA | 2003 | UUUCGUUGGACUUACUUGG | 59% |
| 14112 | 869 | 2004 | AUGAUGAGAGCAA | 2005 | UUGCUCUCAUCAUUGGCUU | 89% |
| 14113 | 701 | 2006 | GCGAGGAGUUGAA | 2007 | UUCAACUCCUCGCUUUCCA | 95% |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14114 | 896 | 2008 | UGAUUGAUAGUCA | 2009 | UGACUAUCAAUCACAUCGG | 87% |
| 14115 | 1035 | 2010 | AGAUAGUGCAUCU | 2011 | AGAUGCACUAUCUAAUUCA | 82% |
| 14116 | 1170 | 2012 | AUGUGUAUCUAUU | 2013 | AAUAGAUACACAUUCAACC | 36% |
| 14117 | 1282 | 2014 | UUCUAUAGAAGAA | 2015 | UUCUUCUAUAGAAUGAACA | 91% |
| 14118 | 1537 | 2016 | UUGUCCAGCAAUU | 2017 | AAUUGCUGGACAACCGUGG | 152% |
| 14119 | 692 | 2018 | ACAUGGAAAGCGA | 2019 | UCGCUUUCCAUGUGUGAGG | n/a |
| 14120 | 840 | 2020 | GCAGUCCAGAUUA | 2021 | UAAUCUGGACUGCUUGUGG | 87% |
| 14121 | 1163 | 2022 | UGGUUGAAUGUGU | 2023 | ACACAUUCAACCAUAAAC | 31% |
| 14122 | 789 | 2024 | UUAUGAAACGAGU | 2025 | ACUCGUUUCAUAACUGUCC | 96% |
| 14123 | 841 | 2026 | CAGUCCAGAUUAU | 2027 | AUAAUCGGACUGCUUGUG | 110% |
| 14124 | 852 | 2028 | AUAUAAGCGGAAA | 2029 | UUUCCGCUUAUAUAAUCUG | 91% |
| 14125 | 209 | 2030 | UACCAGUUAAACA | 2031 | UGUUUAACUGGUAUGGCAC | 110% |
| 14126 | 1276 | 2032 | UGUUCAUUCUAUA | 2033 | UAUAGAAUGAACAUAGACA | n/a |
| 14127 | 137 | 2034 | CCGACCAAGGAAA | 2035 | UUUCCUUGGUCGGCGUUUG | 71% |
| 14128 | 711 | 2036 | GAAUGGUGCAUAC | 2037 | GUAUGCACCAUUCAACUCC | 115% |
| 14129 | 582 | 2038 | AUAUGAUGGCCGA | 2039 | UCGGCCAUCAUAUGUGUCU | 97% |
| 14130 | 839 | 2040 | AGCAGUCCAGAUU | 2041 | AAUCUGGACUGCUUGGC | 102% |
| 14131 | 1091 | 2042 | GCAUUUAGUCAAA | 2043 | UUUGACUAAAUGCAAAGUG | 10% |
| 14132 | 884 | 2044 | AGCAUUCCGAUGU | 2045 | ACAUCGGAAUGCUCAUUGC | 93% |
| 14133 | 903 | 2046 | UAGUCAGGAACUU | 2047 | AAGUUCCUGACUAUCAAUC | 97% |
| 14134 | 1090 | 2048 | UGCAUUUAGUCAA | 2049 | UUGACUAAAUGCAAAGUGA | 39% |
| 14135 | 474 | 2050 | GUCUGAUGAGUCU | 2051 | AGACUCAUCAGACUGGUGA | 99% |
| 14136 | 575 | 2052 | UAGACACAUAUGA | 2053 | UCAUAUGUGUCUACUGUGG | 108% |
| 14137 | 671 | 2054 | CAGACGAGGACAU | 2055 | AUGUCCUCGUCUGUAGCAU | 98% |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14138 | 924 | 2056 | CAGCCGUGAAUUC | 2057 | GAAUUCACGGCUGACUUUG | 100% |
| 14139 | 1185 | 2058 | AGUCUGGAAAUAA | 2059 | UUAUUUCCAGACUCAAAUA | 47% |
| 14140 | 1221 | 2060 | AGUUUGUGGCUUC | 2061 | GAAGCCACAAACUAAACUA | 100% |
| 14141 | 347 | 2062 | AGUCCAACGAAAG | 2063 | CUUUCGUUGGACUUACUUG | 103% |
| 14142 | 634 | 2064 | AAGUUUCGCAGAC | 2065 | GUCUGCGAAACUUCUUAGA | 100% |
| 14143 | 877 | 2066 | AGCAAUGAGCAUU | 2067 | AAUGCUCAUUGCUCUCAUC | 104% |
| 14144 | 1033 | 2068 | UUAGAUAGUGCAU | 2069 | AUGCACUAUCUAAUUCAUG | 95% |
| 14145 | 714 | 2070 | UGGUGCAUACAAG | 2071 | CUUGUAUGCACCAUUCAAC | 101% |
| 14146 | 791 | 2072 | AUGAAACGAGUCA | 2073 | UGACUCGUUUCAUAACUGU | 100% |
| 14147 | 813 | 2074 | CCAGAGUGCUGAA | 2075 | UUCAGCACUCUGGUCAUCC | 97% |
| 14148 | 939 | 2076 | CAGCCAUGAAUUU | 2077 | AAAUUCAUGGCUGUGGAAU | 109% |
| 14149 | 1161 | 2078 | AUUGGUUGAAUGU | 2079 | ACAUUCAACCAAUAAACUG | 34% |
| 14150 | 1164 | 2080 | GGUUGAAUGUGUA | 2081 | UACACAUUCAACCAAUAAA | n/a |
| 14151 | 1190 | 2082 | GGAAAUAACUAAU | 2083 | AUUAGUUAUUUCCAGACUC | n/a |
| 14152 | 1333 | 2084 | UCAUGAAUAGAAA | 2085 | UUUCUAUUCAUGAGAGAAU | 31% |
| 14153 | 537 | 2086 | GCCAGCAACCGAA | 2087 | UUCGGUUGCUGGCAGGUCC | n/a |
| 14154 | 684 | 2088 | CACCUCACACAUG | 2089 | CAUGUGUGAGGUGAUGUCC | 100% |
| 14155 | 707 | 2090 | AGUUGAAUGGUGC | 2091 | GCACCAUUCAACUCCUCGC | 99% |
| 14156 | 799 | 2092 | AGUCAGCUGGAUG | 2093 | CAUCCAGCUGACUCGUUUC | 95% |
| 14157 | 853 | 2094 | UAUAAGCGGAAAG | 2095 | CUUUCCGCUUAUAUAAUCU | 106% |
| 14158 | 888 | 2096 | UUCCGAUGUGAUU | 2097 | AAUCACAUCGGAAUGCUCA | 88% |
| 14159 | 1194 | 2098 | AUAACUAAUGUGU | 2099 | ACACAUUAGUUAUUUCCAG | 95% |
| 14160 | 1279 | 2100 | UCAUUCUAUAGAA | 2101 | UUCUAUAGAAUGAACAUAG | 15% |
| 14161 | 1300 | 2102 | AACUAUCACUGUA | 2103 | UACAGUGAUAGUUUGCAUU | 86% |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14162 | 1510 | 2104 | GUCAAUUGCUUAU | 2105 | AUAAGCAAUUGACACCACC | 86% |
| 14163 | 1543 | 2106 | AGCAAUUAAUAAA | 2107 | UUUAUUAAUUGCUGGACAA | 110% |
| 14164 | 434 | 2108 | ACGACUCUGAUGA | 2109 | UCAUCAGAGUCGUUCGAGU | 134% |
| 14165 | 600 | 2110 | UAGUGUGGUUUAU | 2111 | AUAAACCACACUAUCACCU | 102% |
| 14166 | 863 | 2112 | AAGCCAAUGAUGA | 2113 | UCAUCAUUGGCUUUCCGCU | 93% |
| 14167 | 902 | 2114 | AUAGUCAGGAACU | 2115 | AGUUCCUGACUAUCAAUCA | 101% |
| 14168 | 921 | 2116 | AGUCAGCCGUGAA | 2117 | UUCACGGCUGACUUUGGAA | 98% |
| 14169 | 154 | 2118 | ACUACCAUGAGAA | 2119 | UUCUCAUGGUAGUGAGUUU | n/a |
| 14170 | 217 | 2120 | AAACAGGCUGAUU | 2121 | AAUCAGCCUGUUUAACUGG | 66% |
| 14171 | 816 | 2122 | GAGUGCUGAAACC | 2123 | GGUUUCAGCACUCUGGUCA | 102% |
| 14172 | 882 | 2124 | UGAGCAUUCCGAU | 2125 | AUCGGAAUGCUCAUUGCUC | 103% |
| 14173 | 932 | 2126 | AAUUCCACAGCCA | 2127 | UGGCUGUGGAAUUCACGGC | n/a |
| 14174 | 1509 | 2128 | UGUCAAUUGCUUA | 2129 | UAAGCAAUUGACACCACCA | n/a |
| 14175 | 157 | 2130 | ACCAUGAGAAUUG | 2131 | CAAUUCUCAUGGUAGUGAG | 109% |
| 14176 | 350 | 2132 | CCAACGAAAGCCA | 2133 | UGGCUUUCGUUGGACUUAC | 95% |
| 14177 | 511 | 2134 | CUGGUCACUGAUU | 2135 | AAUCAGUGACCAGUUCAUC | 100% |
| 14178 | 605 | 2136 | UGGUUUAUGGACU | 2137 | AGUCCAUAAACCACACUAU | 99% |
| 14179 | 811 | 2138 | GACCAGAGUGCUG | 2139 | CAGCACUCUGGUCAUCCAG | 88% |
| 14180 | 892 | 2140 | GAUGUGAUUGAUA | 2141 | UAUCAAUCACAUCGGAAUG | 76% |
| 14181 | 922 | 2142 | GUCAGCCGUGAAU | 2143 | AUUCACGGCUGACUUUGGA | 59% |
| 14182 | 1169 | 2144 | AAUGUGUAUCUAU | 2145 | AUAGAUACACAUUCAACCA | 69% |
| 14183 | 1182 | 2146 | UUGAGUCUGGAAA | 2147 | UUUCCAGACUCAAAUAGAU | n/a |
| 14184 | 1539 | 2148 | GUCCAGCAAUUAA | 2149 | UUAAUUGCUGGACAACCGU | 77% |
| 14185 | 1541 | 2150 | CCAGCAAUUAAUA | 2151 | UAUUAAUUGCUGGACAACC | n/a |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14186 | 427 | 2152 | GACUCGAACGACU | 2153 | AGUCGUUCGAGUCAAUGGA | 69% |
| 14187 | 533 | 2154 | ACCUGCCAGCAAC | 2155 | GUUGCUGGCAGGUCCGUGG | 78% |
| 18538 | 496 | 2156 | GAUGAAUCUGAUA | 2157 | UAUCAGAUUCAUCAGAAUG | 74% |
| 18539 | 496 | 2158 | UGAUGAAUCUGAUA | 2159 | UAUCAGAUUCAUCAGAAUG | 72% |
| 18540 | 175 | 2160 | AUUUGCUUUUGCA | 2161 | UGCAAAAGCAAAUCACUGC | 98% |
| 18541 | 175 | 2162 | GAUUUGCUUUUGCA | 2163 | UGCAAAAGCAAAUCACUGC | 28% |
| 18542 | 172 | 2164 | GUGAUUUGCUUUA | 2165 | UAAAGCAAAUCACUGCAAU | 24% |
| 18543 | 172 | 2166 | AGUGAUUUGCUUUA | 2167 | UAAAGCAAAUCACUGCAAU | 14% |
| 18544 | 1013 | 2168 | AAUUUCGUAUUUA | 2169 | UAAAUACGAAAUUUCAGGU | 100% |
| 18545 | 1013 | 2170 | AAAUUUCGUAUUUA | 2171 | UAAAUACGAAAUUUCAGGU | 109% |
| 18546 | 952 | 2172 | CACAGCCAUGAAA | 2173 | UUUCAUGGCUGUGAAAUUC | 32% |
| 18547 | 952 | 2174 | UCACAGCCAUGAAA | 2175 | UUUCAUGGCUGUGAAAUUC | 33% |
| 18548 | 174 | 2176 | GAUUUGCUUUUGA | 2177 | UCAAAAGCAAAUCACUGCA | 57% |
| 18549 | 174 | 2178 | UGAUUUGCUUUUGA | 2179 | UCAAAAGCAAAUCACUGCA | 53% |
| 18550 | 177 | 2180 | UUGCUUUUGCCUA | 2181 | UAGGCAAAAGCAAAUCACU | 97% |
| 18551 | 177 | 2182 | UUUGCUUUUGCCUA | 2183 | UAGGCAAAAGCAAAUCACU | 103% |
| 18552 | 1150 | 2184 | UUUCUCAGUUUAA | 2185 | UUAAACUGAGAAAGAAGCA | 96% |
| 18553 | 1089 | 2186 | UUGCAUUUAGUCA | 2187 | UGACUAAAUGCAAAGUGAG | 94% |
| 18554 | 1086 | 2188 | ACUUUGCAUUUAA | 2189 | UUAAAUGCAAAGUGAGAAA | n/a |
| 18555 | 1093 | 2190 | AUUUAGUCAAAAA | 2191 | UUUUUGACUAAAUGCAAAG | n/a |
| 18556 | 1147 | 2192 | UUCUUUCUCAGUA | 2193 | UACUGAGAAAGAAGCAUUU | n/a |
| 18557 | 1148 | 2194 | UCUUUCUCAGUUA | 2195 | UAACUGAGAAAGAAGCAUU | 66% |
| 18558 | 1128 | 2196 | GAAAGAGAACAUA | 2197 | UAUGUUCUCUUUCAUUUUG | 16% |
| 18559 | 1087 | 2198 | CUUUGCAUUUAGA | 2199 | UCUAAAUGCAAAGUGAGAA | 28% |

TABLE 13-continued

Inhibition of gene expression with SPP1 sd-rxRNA sequences
(Accession Number: NM_000582.2)

| Oligo Number | Start Site | SEQ ID NO | Sense sequence | SEQ ID NO | Antisense sequence | % remaining expression (1 uM A549) |
|---|---|---|---|---|---|---|
| 18560 | 1088 | 2200 | UUUGCAUUUAGUA | 2201 | UACUAAAUGCAAAGU GAGA | n/a |
| 18561 | 1083 | 2202 | CUCACUUUGCAUA | 2203 | UAUGCAAAGUGAGAA AUUG | 53% |
| 18562 | 1081 | 2204 | UUCUCACUUUGCA | 2205 | UGCAAAGUGAGAAAU UGUA | 89% |
| 18563 | 555 | 2206 | CACUCCAGUUGUA | 2207 | UACAACUGGAGUGAA AACU | 33% |
| 18564 | 1125 | 2208 | AAUGAAAGAGAAA | 2209 | UUUCUCUUUCAUUU UGCUA | n/a |
| 18565 | 168 | 2210 | UGCAGUGAUUUGA | 2211 | UCAAAUCACUGCAAU UCUC | 14% |
| 18566 | 1127 | 2212 | UGAAAGAGAACAA | 2213 | UUGUUCUCUUUCAU UUUGC | 27% |
| 18567 | 1007 | 2214 | ACCUGAAAUUUCA | 2215 | UGAAAUUUCAGGUG UUUAU | 129% |
| 18568 | 164 | 2216 | GAAUUGCAGUGAA | 2217 | UUCACUGCAAUUCUC AUGG | 47% |
| 18569 | 222 | 2218 | GGCUGAUUCUGGA | 2219 | UCCAGAAUCAGCCUG UUUA | n/a |

TABLE 14

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | % remaining expression (1 uM A549) | % remaining expression (1 uM PC-3) |
|---|---|---|---|---|---|---|---|
| 14422 | 451 | 2220 | CACAUUUGAUUGA | 2221 | UCAAUCAAAUGUGAUC UGG | 72% | |
| 14423 | 1769 | 2222 | CACUGCCUCAAUU | 2223 | AAUUGAGGCAGUGUU GAUG | 71% | |
| 14424 | 1464 | 2224 | AAAUACCAGUCUU | 2225 | AAGACUGGUAUUUCAU CUG | 74% | |
| 14425 | 453 | 2226 | CAUUUGAUUGACA | 2227 | UGUCAAUCAAAUGUGA UCU | 83% | |
| 17388 | 285 | 2228 | GAAAACUGCUCAA | 2229 | UUGAGCAGUUUUCUCC AUA | | 88% |
| 17389 | 520 | 2230 | ACCUCUCCUAUUA | 2231 | UAAUAGGAGAGGUUA GAGA | | 25% |
| 17390 | 467 | 2232 | UCCACCAACUUAA | 2233 | UUAAGUUGGUGGACU GUCA | | 68% |
| 17391 | 467 | 2234 | GUCCACCAACUUAA | 2235 | UUAAGUUGGUGGACU GUCA | | 101% |

TABLE 14-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 17392 | 524 | 2236 | CUCCUAUUAUACA | 2237 | UGUAUAAUAGGAGAGGUUA | 49% |
| 17393 | 448 | 2238 | GAUCACAUUUGAA | 2239 | UUCAAAUGUGAUCUGGAUG | 29% |
| 17394 | 448 | 2240 | AGAUCACAUUUGAA | 2241 | UUCAAAUGUGAUCUGGAUG | 31% |
| 17395 | 519 | 2242 | AACCUCUCCUAUA | 2243 | UAUAGGAGAGGUUAGAGAA | 12% |
| 17396 | 437 | 2244 | GUUGACAUCCAGA | 2245 | UCUGGAUGUCAACACAUAA | 86% |
| 17397 | 406 | 2246 | CCUUCCUUCGAAA | 2247 | UUUCGAAGGAAGGGAAUGU | 23% |
| 17398 | 339 | 2248 | ACUCCAAACACAA | 2249 | UUGUGUUUGGAGUGGGUUU | 102% |
| 17399 | 339 | 2250 | CACUCCAAACACAA | 2251 | UUGUGUUUGGAGUGGGUUU | 55% |
| 17400 | 338 | 2252 | CACUCCAAACACA | 2253 | UGUGUUUGGAGUGGGUUUC | 62% |
| 17401 | 468 | 2254 | CCACCAACUUACA | 2255 | UGUAAGUUGGUGGACUGUC | 61% |
| 17402 | 468 | 2256 | UCCACCAACUUACA | 2257 | UGUAAGUUGGUGGACUGUC | 179% |
| 17403 | 1465 | 2258 | AAUACCAGUCUUA | 2259 | UAAGACUGGUAUUUCAUCU | 30% |
| 17404 | 243 | 2260 | GACCAGUAUAAGA | 2261 | UCUUAUACUGGUCAAAUCC | 32% |
| 17405 | 1472 | 2262 | GUCUUUUAAUGAA | 2263 | UUCAUUAAAAGACUGGUAU | 15% |
| 17406 | 2446 | 2264 | AAUUUCAUGUCUA | 2265 | UAGACAUGAAAUUACUGGU | 142% |
| 17407 | 449 | 2266 | AUCACAUUUGAUA | 2267 | UAUCAAAUGUGAUCUGGAU | 54% |
| 17408 | 449 | 2268 | GAUCACAUUUGAUA | 2269 | UAUCAAAUGUGAUCUGGAU | 27% |
| 17409 | 444 | 2270 | UCCAGAUCACAUA | 2271 | UAUGUGAUCUGGAUGUCAA | 49% |
| 17410 | 1093 | 2272 | UACUGAUAGGAGA | 2273 | UCUCCUAUCAGUAUUAGCC | 32% |
| 17411 | 1134 | 2274 | GUGCAACACUUGA | 2275 | UCAAGUGUUGCACAUAAUC | 70% |
| 17412 | 244 | 2276 | ACCAGUAUAAGUA | 2277 | UACUUAUACUGGUCAAAUC | 63% |
| 17413 | 1946 | 2278 | GAAGUCUAAUGAA | 2279 | UUCAUUAGACUUCUACAGU | 19% |
| 17414 | 638 | 2280 | AAGAAGAAAGUUA | 2281 | UAACUUUCUUCUUAGAAGC | 27% |
| 17415 | 450 | 2282 | UCACAUUUGAUUA | 2283 | UAAUCAAAUGUGAUCUGGA | 216% |
| 17416 | 450 | 2284 | AUCACAUUUGAUUA | 2285 | UAAUCAAAUGUGAUCUGGA | 32% |

TABLE 14-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 17417 | 452 | 2286 | ACAUUUGAUUGAA | 2287 | UUCAAUCAAAUGUGAUCUG | 99% |
| 17418 | 452 | 2288 | CACAUUUGAUUGAA | 2289 | UUCAAUCAAAUGUGAUCUG | 54% |
| 17419 | 454 | 2290 | AUUUGAUUGACAA | 2291 | UUGUCAAUCAAAUGUGAUC | 86% |
| 17420 | 454 | 2292 | CAUUUGAUUGACAA | 2293 | UUGUCAAUCAAAUGUGAUC | 89% |
| 17421 | 1790 | 2294 | CAUCUGCAAUAAA | 2295 | UUUAUUGCAGAUGAGAGAC | 55% |
| 17422 | 1790 | 2296 | UCAUCUGCAAUAAA | 2297 | UUUAUUGCAGAUGAGAGAC | 62% |

TABLE 15

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 13980 | 1222 | 2298 | ACAGGAAGAUGUA | 2299 | UACAUCUUCCUGUAGUACA | 98% |
| 13981 | 813 | 2300 | GAGUGGAGCGCCU | 2301 | AGGCGCUCCACUCUGUGGU | 82% |
| 13982 | 747 | 2302 | CGACUGGAAGACA | 4206 | UGUCUUCCAGUCGGUAAGC | 116% |
| 13983 | 817 | 2303 | GGAGCGCCUGUUC | 4207 | GAACAGGCGCUCCACUCUG | 97% |
| 13984 | 1174 | 2304 | GCCAUUACAACUG | 4208 | CAGUUGUAAUGGCAGGCAC | 102% |
| 13985 | 1005 | 2305 | GAGCUUUCUGGCU | 4209 | AGCCAGAAAGCUCAAACUU | 114% |
| 13986 | 814 | 2306 | AGUGGAGCGCCUG | 4210 | CAGGCGCUCCACUCUGUGG | 111% |
| 13987 | 816 | 2307 | UGGAGCGCCUGUU | 4211 | AACAGGCGCUCCACUCUGU | 102% |
| 13988 | 1001 | 2308 | GUUUGAGCUUUCU | 4212 | AGAAAGCUCAAACUUGAUA | 99% |
| 13989 | 1173 | 2309 | UGCCAUUACAACU | 4213 | AGUUGUAAUGGCAGGCACA | 107% |
| 13990 | 749 | 2310 | ACUGGAAGACACG | 4214 | CGUGUCUUCCAGUCGGUAA | 91% |
| 13991 | 792 | 2311 | AACUGCCUGGUCC | 4215 | GGACCAGGCAGUUGGCUCU | 97% |
| 13992 | 1162 | 2312 | AGACCUGUGCCUG | 4216 | CAGGCACAGGUCUUGAUGA | 107% |
| 13993 | 811 | 2313 | CAGAGUGGAGCGC | 4217 | GCGCUCCACUCUGUGGUCU | 113% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 13994 | 797 | 2314 | CCUGGUCCAGACC | 4218 | GGUCUGGACCAGGCAGUUG | n/a |
| 13995 | 1175 | 2315 | CCAUUACAACUGU | 4219 | ACAGUUGUAAUGGCAGGCA | 113% |
| 13996 | 1172 | 2316 | CUGCCAUUACAAC | 4220 | GUUGUAAUGGCAGGCACAG | 110% |
| 13997 | 1177 | 2317 | AUUACAACUGUCC | 4221 | GGACAGUUGUAAUGGCAGG | 105% |
| 13998 | 1176 | 2318 | CAUUACAACUGUC | 4222 | GACAGUUGUAAUGGCAGGC | 89% |
| 13999 | 812 | 2319 | AGAGUGGAGCGCC | 4223 | GGCGCUCCACUCUGUGGUC | 99% |
| 14000 | 745 | 2320 | ACCGACUGGAAGA | 4224 | UCUUCCAGUCGGUAAGCCG | n/a |
| 14001 | 1230 | 2321 | AUGUACGGAGACA | 4225 | UGUCUCCGUACAUCUUCCU | 106% |
| 14002 | 920 | 2322 | GCCUUGCGAAGCU | 4226 | AGCUUCGCAAGGCCUGACC | 93% |
| 14003 | 679 | 2323 | GCUGCGAGGAGUG | 4227 | CACUCCUCGCAGCAUUUCC | 102% |
| 14004 | 992 | 2324 | GCCUAUCAAGUUU | 4228 | AAACUUGAUAGGCUUGGAG | 100% |
| 14005 | 1045 | 2325 | AAUUCUGUGGAGU | 4229 | ACUCCACAGAAUUUAGCUC | 104% |
| 14006 | 1231 | 2326 | UGUACGGAGACAU | 4230 | AUGUCUCCGUACAUCUUCC | 87% |
| 14007 | 991 | 2327 | AGCCUAUCAAGUU | 4231 | AACUUGAUAGGCUUGGAGA | 101% |
| 14008 | 998 | 2328 | CAAGUUUGAGCUU | 4232 | AAGCUCAAACUUGAUAGGC | 98% |
| 14009 | 1049 | 2329 | CUGUGGAGUAUGU | 4233 | ACAUACUCCACAGAAUUUA | 98% |
| 14010 | 1044 | 2330 | AAAUUCUGUGGAG | 4234 | CUCCACAGAAUUUAGCUCG | 93% |
| 14011 | 1327 | 2331 | UUUCAGUAGCACA | 4235 | UGUGCUACUGAAAUCAUUU | 95% |
| 14012 | 1196 | 2332 | CAAUGACAUCUUU | 4236 | AAAGAUGUCAUUGUCUCCG | 101% |
| 14013 | 562 | 2333 | AGUACCAGUGCAC | 4237 | GUGCACUGGUACUUGCAGC | 66% |
| 14014 | 752 | 2334 | GGAAGACACGUUU | 4238 | AAACGUGUCUUCCAGUCGG | 95% |
| 14015 | 994 | 2335 | CUAUCAAGUUUGA | 4239 | UCAAACUUGAUAGGCUUGG | 85% |
| 14016 | 1040 | 2336 | AGCUAAAUUCUGU | 4240 | ACAGAAUUUAGCUCGGUAU | 61% |
| 14017 | 1984 | 2337 | AGGUAGAAUGUAA | 4241 | UUACAUUCUACCAUGGUG | 32% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14018 | 2195 | 2338 | AGCUGAUCAGUUU | 4242 | AAACUGAUCAGCUAUAUAG | 86% |
| 14019 | 2043 | 2339 | UUCUGCUCAGAUA | 4243 | UAUCUGAGCAGAAUUUCCA | 81% |
| 14020 | 1892 | 2340 | UUAUCUAAGUUAA | 4244 | UUAACUUAGAUAACUGUAC | 84% |
| 14021 | 1567 | 2341 | UAUACGAGUAAUA | 4245 | UAUUACUCGUAUAAGAUGC | 72% |
| 14022 | 1780 | 2342 | GACUGGACAGCUU | 4246 | AAGCUGUCCAGUCUAAUCG | 65% |
| 14023 | 2162 | 2343 | AUGGCCUUUAUUA | 4247 | UAAUAAAGGCCAUUUGUUC | 80% |
| 14024 | 1034 | 2344 | AUACCGAGCUAAA | 4248 | UUUAGCUCGGUAUGUCUUC | 91% |
| 14025 | 2264 | 2345 | UUGUUGAGAGUGU | 4249 | ACACUCUCAACAAAUAAAC | 58% |
| 14026 | 1032 | 2346 | ACAUACCGAGCUA | 4250 | UAGCUCGGUAUGUCUUCAU | 106% |
| 14027 | 1535 | 2347 | AGCAGAAAGGUUA | 4251 | UAACCUUUCUGCUGGUACC | 67% |
| 14028 | 1694 | 2348 | AGUUGUUCCUUAA | 4252 | UUAAGGAACAACUUGACUC | 94% |
| 14029 | 1588 | 2349 | AUUUGAAGUGUAA | 4253 | UUACACUUCAAAUAGCAGG | 97% |
| 14030 | 928 | 2350 | AAGCUGACCUGGA | 4254 | UCCAGGUCAGCUUCGCAAG | 100% |
| 14031 | 1133 | 2351 | GGUCAUGAAGAAG | 4255 | CUUCUUCAUGACCUCGCCG | 82% |
| 14032 | 912 | 2352 | AUGGUCAGGCCUU | 4256 | AAGGCCUGACCAUGCACAG | 84% |
| 14033 | 753 | 2353 | GAAGACACGUUUG | 4257 | CAAACGUGUCUUCCAGUCG | 86% |
| 14034 | 918 | 2354 | AGGCCUUGCGAAG | 4258 | CUUCGCAAGGCCUGACCAU | 88% |
| 14035 | 744 | 2355 | UACCGACUGGAAG | 4259 | CUUCCAGUCGGUAAGCCGC | 95% |
| 14036 | 466 | 2356 | ACCGCAAGAUCGG | 4260 | CCGAUCUUGCGGUUGGCCG | 73% |
| 14037 | 917 | 2357 | CAGGCCUUGCGAA | 4261 | UUCGCAAGGCCUGACCAUG | 86% |
| 14038 | 1038 | 2358 | CGAGCUAAAUUCU | 4262 | AGAAUUUAGCUCGGUAUGU | 84% |
| 14039 | 1048 | 2359 | UCUGUGGAGUAUG | 4263 | CAUACUCCACAGAAUUUAG | 87% |
| 14040 | 1235 | 2360 | CGGAGACAUGGCA | 4264 | UGCCAUGUCUCCGUACAUC | 100% |
| 14041 | 868 | 2361 | AUGACAACGCCUC | 4265 | GAGGCGUUGUCAUUGGUAA | 104% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14042 | 1131 | 2362 | GAGGUCAUGAAGA | 4266 | UCUUCAUGACCUCGCCGUC | 85% |
| 14043 | 1043 | 2363 | UAAAUUCUGUGGA | 4267 | UCCACAGAAUUUAGCUCGG | 74% |
| 14044 | 751 | 2364 | UGGAAGACACGUU | 4268 | AACGUGUCUUCCAGUCGGU | 84% |
| 14045 | 1227 | 2365 | AAGAUGUACGGAG | 4269 | CUCCGUACAUCUUCCUGUA | 99% |
| 14046 | 867 | 2366 | AAUGACAACGCCU | 4270 | AGGCGUUGUCAUUGGUAAC | 94% |
| 14047 | 1128 | 2367 | GGCGAGGUCAUGA | 4271 | UCAUGACCUCGCCGUCAGG | 89% |
| 14048 | 756 | 2368 | GACACGUUUGGCC | 4272 | GGCCAAACGUGUCUUCCAG | 93% |
| 14049 | 1234 | 2369 | ACGGAGACAUGGC | 4273 | GCCAUGUCUCCGUACAUCU | 100% |
| 14050 | 916 | 2370 | UCAGGCCUUGCGA | 4274 | UCGCAAGGCCUGACCAUGC | 96% |
| 14051 | 925 | 2371 | GCGAAGCUGACCU | 4275 | AGGUCAGCUUCGCAAGGCC | 80% |
| 14052 | 1225 | 2372 | GGAAGAUGUACGG | 4276 | CCGUACAUCUUCCUGUAGU | 96% |
| 14053 | 445 | 2373 | GUGACUUCGGCUC | 4277 | GAGCCGAAGUCACAGAAGA | 101% |
| 14054 | 446 | 2374 | UGACUUCGGCUCC | 4278 | GGAGCCGAAGUCACAGAAG | 93% |
| 14055 | 913 | 2375 | UGGUCAGGCCUUG | 4279 | CAAGGCCUGACCAUGCACA | 67% |
| 14056 | 997 | 2376 | UCAAGUUUGAGCU | 4280 | AGCUCAAACUUGAUAGGCU | 92% |
| 14057 | 277 | 2377 | GCCAGAACUGCAG | 4281 | CUGCAGUUCUGGCCGACGG | 84% |
| 14058 | 1052 | 2378 | UGGAGUAUGUACC | 4282 | GGUACAUACUCCACAGAAU | n/a |
| 14059 | 887 | 2379 | GCUAGAGAAGCAG | 4283 | CUGCUUCUCUAGCCUGCAG | 80% |
| 14060 | 914 | 2380 | GGUCAGGCCUUGC | 4284 | GCAAGGCCUGACCAUGCAC | 112% |
| 14061 | 1039 | 2381 | GAGCUAAAUUCUG | 4285 | CAGAAUUUAGCUCGGUAUG | 104% |
| 14062 | 754 | 2382 | AAGACACGUUUGG | 4286 | CCAAACGUGUCUUCCAGUC | 109% |
| 14063 | 1130 | 2383 | CGAGGUCAUGAAG | 4287 | CUUCAUGACCUCGCCGUCA | 103% |
| 14064 | 919 | 2384 | GGCCUUGCGAAGC | 4288 | GCUUCGCAAGGCCUGACCA | 109% |
| 14065 | 922 | 2385 | CUUGCGAAGCUGA | 4289 | UCAGCUUCGCAAGGCCUGA | 106% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14066 | 746 | 2386 | CCGACUGGAAGAC | 4290 | GUCUUCCAGUCGGUAAGCC | 106% |
| 14067 | 993 | 2387 | CCUAUCAAGUUUG | 4291 | CAAACUUGAUAGGCUUGGA | 67% |
| 14068 | 825 | 2388 | UGUUCCAAGACCU | 4292 | AGGUCUUGGAACAGGCGCU | 93% |
| 14069 | 926 | 2389 | CGAAGCUGACCUG | 4293 | CAGGUCAGCUUCGCAAGGC | 95% |
| 14070 | 923 | 2390 | UUGCGAAGCUGAC | 4294 | GUCAGCUUCGCAAGGCCUG | 95% |
| 14071 | 866 | 2391 | CAAUGACAACGCC | 4295 | GGCGUUGUCAUUGGUAACC | 132% |
| 14072 | 563 | 2392 | GUACCAGUGCACG | 4296 | CGUGCACUGGUACUUGCAG | n/a |
| 14073 | 823 | 2393 | CCUGUUCCAAGAC | 4297 | GUCUUGGAACAGGCGCUCC | 98% |
| 14074 | 1233 | 2394 | UACGGAGACAUGG | 4298 | CCAUGUCUCCGUACAUCUU | 109% |
| 14075 | 924 | 2395 | UGCGAAGCUGACC | 4299 | GGUCAGCUUCGCAAGGCCU | 95% |
| 14076 | 921 | 2396 | CCUUGCGAAGCUG | 4300 | CAGCUUCGCAAGGCCUGAC | 116% |
| 14077 | 443 | 2397 | CUGUGACUUCGGC | 4301 | GCCGAAGUCACAGAAGAGG | 110% |
| 14078 | 1041 | 2398 | GCUAAAUUCUGUG | 4302 | CACAGAAUUUAGCUCGGUA | 99% |
| 14079 | 1042 | 2399 | CUAAAUUCUGUGG | 4303 | CCACAGAAUUUAGCUCGGU | 109% |
| 14080 | 755 | 2400 | AGACACGUUUGGC | 4304 | GCCAAACGUGUCUUCCAGU | 121% |
| 14081 | 467 | 2401 | CCGCAAGAUCGGC | 4305 | GCCGAUCUUGCGGUUGGCC | 132% |
| 14082 | 995 | 2402 | UAUCAAGUUUGAG | 4306 | CUCAAACUUGAUAGGCUUG | 105% |
| 14083 | 927 | 2403 | GAAGCUGACCUGG | 4307 | CCAGGUCAGCUUCGCAAGG | 114% |
| 17356 | 1267 | 2404 | ACAUUAACUCAUA | 4308 | UAUGAGUUAAUGUCUCUCA | 120% |
| 17357 | 1267 | 2405 | GACAUUAACUCAUA | 2406 | UAUGAGUUAAUGUCUCUCA | 56% |
| 17358 | 1442 | 2407 | UGAAGAAUGUUAA | 2408 | UUAACAUUCUUCAAACCAG | 34% |
| 17359 | 1442 | 2409 | UUGAAGAAUGUUAA | 2410 | UUAACAUUCUUCAAACCAG | 31% |
| 17360 | 1557 | 2411 | GAUAGCAUCUUAA | 2412 | UUAAGAUGCUAUCUGAUGA | 59% |
| 17361 | 1557 | 2413 | AGAUAGCAUCUUAA | 2414 | UUAAGAUGCUAUCUGAUGA | 47% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 17362 | 1591 | 2415 | UGAAGUGUAAUUA | 2416 | UAAUUACACUUCAAAUAGC | 120% |
| 17363 | 1599 | 2417 | AAUUGAGAAGGAA | 2418 | UUCCUUCUCAAUUACACUU | 71% |
| 17364 | 1601 | 2419 | UUGAGAAGGAAAA | 2420 | UUUUCCUUCUCAAUUACAC | 62% |
| 17365 | 1732 | 2421 | CAUUCUGAUUCGA | 2422 | UCGAAUCAGAAUGUCAGAG | 99% |
| 17366 | 1734 | 2423 | UUCUGAUUCGAAA | 2424 | UUUCGAAUCAGAAUGUCAG | 97% |
| 17367 | 1770 | 2425 | CUGUCGAUUAGAA | 2426 | UUCUAAUCGACAGGAUUCC | 45% |
| 17368 | 1805 | 2427 | UUUGCCUGUAACA | 2428 | UGUUACAGGCAAAUUCACU | 71% |
| 17369 | 1805 | 2429 | AUUUGCCUGUAACA | 2430 | UGUUACAGGCAAAUUCACU | 67% |
| 17370 | 1815 | 2431 | ACAAGCCAGAUUA | 2432 | UAAUCUGGCUUGUUACAGG | 65% |
| 17371 | 1815 | 2433 | AACAAGCCAGAUUA | 2434 | UAAUCUGGCUUGUUACAGG | 35% |
| 17372 | 2256 | 2435 | CAGUUUAUUUGUA | 2436 | UACAAAUAAACUGUCCGAA | 113% |
| 17373 | 2265 | 2437 | UGUUGAGAGUGUA | 2438 | UACACUCUCAACAAAUAAA | 35% |
| 17374 | 2265 | 2439 | UUGUUGAGAGUGUA | 2440 | UACACUCUCAACAAAUAAA | 31% |
| 17375 | 2295 | 2441 | UGCACCUUUCUAA | 2442 | UUAGAAAGGUGCAAACAUG | 34% |
| 17376 | 2295 | 2443 | UUGCACCUUUCUAA | 2444 | UUAGAAAGGUGCAAACAUG | 28% |
| 17377 | 1003 | 2445 | UUGAGCUUUCUGA | 2446 | UCAGAAAGCUCAAACUUGA | 67% |
| 17378 | 2268 | 2447 | UGAGAGUGUGACA | 2448 | UGUCACACUCUCAACAAAU | 42% |
| 17379 | 2272 | 2449 | AGUGUGACCAAAA | 2450 | UUUUGGUCACACUCUCAAC | 35% |
| 17380 | 2272 | 2451 | GAGUGUGACCAAAA | 2452 | UUUUGGUCACACUCUCAAC | 29% |
| 17381 | 2273 | 2453 | GUGUGACCAAAAA | 2454 | UUUUUGGUCACACUCUCAA | 42% |
| 17382 | 2274 | 2455 | UGUGACCAAAAGA | 2456 | UCUUUUGGUCACACUCUCA | 42% |
| 17383 | 2274 | 2457 | GUGUGACCAAAAGA | 2458 | UCUUUUGGUCACACUCUCA | 37% |
| 17384 | 2275 | 2459 | GUGACCAAAAGUA | 2460 | UACUUUUGGUCACACUCUC | 24% |
| 17385 | 2277 | 2461 | GACCAAAAGUUAA | 2462 | UUAACUUUUGGUCACACUC | 27% |

TABLE 15-continued

Inhibition of gene expression with CTGF sd-rxRNA sequences
(Accession number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 17386 | 2296 | 2463 | GCACCUUUCUAGA | 2464 | UCUAGAAAGGUGCAAACAU | 23% |
| 17387 | 2299 | 2465 | CCUUUCUAGUUGA | 2466 | UCAACUAGAAAGGUGCAAA | 46% |

TABLE 16

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 14408 | 1324 | 2467 | GGCUCUCCUUCGA | 2468 | UCGAAGGAGAGCCAUUCGC | 94% |
| 14409 | 1374 | 2469 | GACAGGAACCUGG | 2470 | CCAGGUUCCUGUCUUUAUG | n/a |
| 14410 | 946 | 2471 | CCAAGGAGGUUUA | 2472 | UAAACCUCCUUGGCGUAGU | 90% |
| 14411 | 849 | 2473 | AUUUCCAUCUACA | 2474 | UGUAGAUGGAAAUCACCUC | 72% |
| 14412 | 852 | 2475 | UCCAUCUACAACA | 2476 | UGUUGUAGAUGGAAAUCAC | 76% |
| 14413 | 850 | 2477 | UUUCCAUCUACAA | 2478 | UUGUAGAUGGAAAUCACCU | 98% |
| 14414 | 944 | 2479 | CGCCAAGGAGGUU | 2480 | AACCUCCUUGGCGUAGUAC | 100% |
| 14415 | 1513 | 2481 | GUGGUGAUCAGAA | 2482 | UUCUGAUCACCACUGGUAU | n/a |
| 14416 | 1572 | 2483 | CUCCUGCUAAUGU | 2484 | ACAUUAGCAGGAGAUGUGG | 100% |
| 14417 | 1497 | 2485 | ACCUCCACAUAUA | 2486 | UAUAUGUGGAGGUGCCAUC | 73% |
| 14418 | 1533 | 2487 | AAGUCCACUAGGA | 2488 | UCCUAGUGGACUUUAUAGU | 98% |
| 14419 | 1514 | 2489 | UGGUGAUCAGAAA | 2490 | UUUCUGAUCACCACUGGUA | 86% |
| 14420 | 1534 | 2491 | AGUCCACUAGGAA | 2492 | UUCCUAGUGGACUUUAUAG | 99% |
| 14421 | 943 | 2493 | ACGCCAAGGAGGU | 2494 | ACCUCCUUGGCGUAGUACU | 41% |
| 18570 | 2445 | 2495 | UAUUUAUUGUGUA | 2496 | UACACAAUAAAUAACUCAC | 79% |
| 18571 | 2445 | 2497 | UUAUUUAUUGUGUA | 2498 | UACACAAUAAAUAACUCAC | 75% |
| 18572 | 2083 | 2499 | AUCAGUGUUAAAA | 2500 | UUUUAACACUGAUGACCA | 47% |
| 18573 | 2083 | 2501 | CAUCAGUGUUAAAA | 2502 | UUUUAACACUGAUGACCA | 17% |

TABLE 16-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 18574 | 2544 | 2503 | AUGGCUUAAGGAA | 2504 | UUCCUUAAGCCAUCC AUGA | 59% |
| 18575 | 2544 | 2505 | GAUGGCUUAAGG AA | 2506 | UUCCUUAAGCCAUCC AUGA | 141% |
| 18576 | 2137 | 2507 | UUGUGUUCUGUUA | 2508 | UAACAGAACACAAAC UUCC | 77% |
| 18577 | 2137 | 2509 | UUUGUGUUCUGU UA | 2510 | UAACAGAACACAAAC UUCC | 59% |
| 18578 | 2520 | 2511 | AAAUACUUUGCCA | 2512 | UGGCAAAGUAUUUG GUCUC | 75% |
| 18579 | 2520 | 2513 | CAAAUACUUUGCCA | 2514 | UGGCAAAGUAUUUG GUCUC | 55% |
| 18580 | 3183 | 2515 | CUUGCACUACAAA | 2516 | UUUGUAGUGCAAGU CAAAC | 84% |
| 18581 | 3183 | 2517 | ACUUGCACUACAAA | 2518 | UUUGUAGUGCAAGU CAAAC | 80% |
| 18582 | 2267 | 2519 | GAAUUUAUUAGUA | 2520 | UACUAAUAAAUUCUU CCAG | 82% |
| 18583 | 2267 | 2521 | AGAAUUUAUUAG UA | 2522 | UACUAAUAAAUUCUU CCAG | 67% |
| 18584 | 3184 | 2523 | UUGCACUACAAAA | 2524 | UUUUGUAGUGCAAG UCAAA | 77% |
| 18585 | 3184 | 2525 | CUUGCACUACAAAA | 2526 | UUUUGUAGUGCAAG UCAAA | 59% |
| 18586 | 2493 | 2527 | AUAAAACAGGUGA | 2528 | UCACCUGUUUUAUU UUCCA | 84% |
| 18587 | 2493 | 2529 | AAUAAAACAGGUGA | 2530 | UCACCUGUUUUAUU UUCCA | 70% |
| 18588 | 2297 | 2531 | GACAACAACAACA | 2532 | UGUUGUUGUUGUCG UUGUU | 40% |
| 18589 | 2046 | 2533 | AUGCUUGUAACAA | 2534 | UUGUUACAAGCAUCA UCGU | 39% |
| 18590 | 2531 | 2535 | CAGAAACUCAUGA | 2536 | UCAUGAGUUUCUGG CAAAG | 56% |
| 18591 | 2389 | 2537 | GUAUUGCUAUGCA | 2538 | UGCAUAGCAAUACAG AAAA | 64% |
| 18592 | 2530 | 2539 | CCAGAAACUCAUA | 2540 | UAUGAGUUUCUGGC AAAGU | 44% |
| 18593 | 2562 | 2541 | ACUCAAACGAGCA | 2542 | UGCUCGUUUGAGUU CAAGU | 87% |
| 18594 | 2623 | 2543 | AUAUGACCGAGAA | 2544 | UUCUCGGUCAUAUAA UAAC | 69% |
| 18595 | 2032 | 2545 | CGACGACAACGAA | 2546 | UUCGUUGUCGUCGU CAUCA | 55% |
| 18596 | 2809 | 2547 | GUAAACCAGUGAA | 2548 | UUCACUGGUUUACUA AACU | 58% |
| 18597 | 2798 | 2549 | UUGUCAGUUUAGA | 2550 | UCUAAACUGACAAAG AACC | 38% |

TABLE 16-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 18598 | 2081 | 2551 | UCAUCAGUGUUAA | 2552 | UUAACACUGAUGAACCAAG | 25% |
| 18599 | 2561 | 2553 | AACUCAAACGAGA | 2554 | UCUCGUUUGAGUUCAAGUU | 57% |
| 18600 | 2296 | 2555 | CGACAACAACAAA | 2556 | UUUGUUGUUGUCGUUGUUC | 69% |
| 18601 | 2034 | 2557 | ACGACAACGAUGA | 2558 | UCAUCGUUGUCGUCGUCAU | 22% |
| 18602 | 2681 | 2559 | GCUGCCUAAGGAA | 2560 | UUCCUUAGGCAGCUGAUAC | 43% |
| 18603 | 2190 | 2561 | AUUCUACAUUUCA | 2562 | UGAAAUGUAGAAUAAGGCC | 128% |

TABLE 17

Inhibition of gene expression with TGFB1 sd-rxRNA sequences
(Accession Number NM_000660.3)

| Oligo Number | Start Site | SEQ ID NO | Sense sequence | SEQ ID NO | Antisense sequence | % remaining expression (1 uM A549) |
|---|---|---|---|---|---|---|
| 14394 | 1194 | 2563 | GCUAAUGGUGGAA | 2564 | UUCCACCAUUAGCACGCGG | 24% |
| 14395 | 2006 | 2565 | UGAUCGUGCGCUC | 2566 | GAGCGCACGAUCAUGUUGG | 79% |
| 14396 | 1389 | 2567 | CAAUUCCUGGCGA | 2568 | UCGCCAGGAAUUGUUGCUG | 77% |
| 14397 | 1787 | 2569 | AGUGGAUCCACGA | 2570 | UCGUGGAUCCACUUCCAGC | n/a |
| 14398 | 1867 | 2571 | UACAGCAAGGUCC | 2572 | GGACCUUGCUGUACUGCGU | 82% |
| 14399 | 2002 | 2573 | AACAUGAUCGUGC | 2574 | GCACGAUCAUGUUGGACAG | n/a |
| 14400 | 2003 | 2575 | ACAUGAUCGUGCG | 2576 | CGCACGAUCAUGUUGGACA | n/a |
| 14401 | 1869 | 2577 | CAGCAAGGUCCUG | 2578 | CAGGACCUUGCUGUACUGC | 82% |
| 14402 | 2000 | 2579 | CCAACAUGAUCGU | 2580 | ACGAUCAUGUUGGACAGCU | 66% |
| 14403 | 986 | 2581 | AGCGGAAGCGCAU | 2582 | AUGCGCUUCCGCUUCACCA | 78% |
| 14404 | 995 | 2583 | GCAUCGAGGCCAU | 2584 | AUGGCCUCGAUGCGCUUCC | 79% |
| 14405 | 963 | 2585 | GACUAUCGACAUG | 2586 | CAUGUCGAUAGUCUUGCAG | 80% |
| 14406 | 955 | 2587 | ACCUGCAAGACUA | 2588 | UAGUCUUGCAGGUGGAUAG | 88% |
| 14407 | 1721 | 2589 | GCUCCACGGAGAA | 2590 | UUCUCCGUGGAGCUGAAGC | n/a |

TABLE 17-continued

Inhibition of gene expression with TGFB1 sd-rxRNA sequences
(Accession Number NM_000660.3)

| Oligo Number | Start Site | SEQ ID NO | Sense sequence | SEQ ID NO | Antisense sequence | % remaining expression (1 uM A549) |
|---|---|---|---|---|---|---|
| 18454 | 1246 | 2591 | CACAGCAUAUAUA | 2592 | UAUAUAUGCUGUGUGUACU | 58% |
| 18455 | 1248 | 2593 | CAGCAUAUAUAUA | 2594 | UAUAUAUAUGCUGUGUGUA | 87% |
| 18456 | 1755 | 2595 | GUACAUUGACUUA | 2596 | UAAGUCAAUGUACAGCUGC | 107% |
| 18457 | 1755 | 2597 | UGUACAUUGACUUA | 2598 | UAAGUCAAUGUACAGCUGC | 77% |
| 18458 | 1708 | 2599 | AACUAUUGCUUCA | 2600 | UGAAGCAAUAGUUGGUGUC | 75% |
| 18459 | 1708 | 2601 | CAACUAUUGCUUCA | 2602 | UGAAGCAAUAGUUGGUGUC | 73% |
| 18460 | 1250 | 2603 | GCAUAUAUAUGUA | 2604 | UACAUAUAUAUGCUGUGUG | n/a |
| 18461 | 1754 | 2605 | UGUACAUUGACUA | 2606 | UAGUCAAUGUACAGCUGCC | 91% |
| 18462 | 1754 | 2607 | CUGUACAUUGACUA | 2608 | UAGUCAAUGUACAGCUGCC | 92% |
| 18463 | 1249 | 2609 | AGCAUAUAUAUGA | 2610 | UCAUAUAUAUGCUGUGUGU | n/a |
| 18464 | 1383 | 2611 | CAGCAACAAUUCA | 2612 | UGAAUUGUUGCUGUAUUUC | 77% |
| 18465 | 1251 | 2613 | CAUAUAUAUGUUA | 2614 | UAACAUAUAUAUGCUGUGU | 84% |
| 18466 | 1713 | 2615 | UUGCUUCAGCUCA | 2616 | UGAGCUGAAGCAAUAGUUG | n/a |
| 18467 | 1713 | 2617 | AUUGCUUCAGCUCA | 2618 | UGAGCUGAAGCAAUAGUUG | 83% |
| 18468 | 1247 | 2619 | ACAGCAUAUAUAA | 2620 | UUAUAUAUGCUGUGUGUAC | 96% |
| 18469 | 1712 | 2621 | AUUGCUUCAGCUA | 2622 | UAGCUGAAGCAAUAGUUGG | 90% |
| 18470 | 1712 | 2623 | UAUUGCUUCAGCUA | 2624 | UAGCUGAAGCAAUAGUUGG | 98% |
| 18471 | 1212 | 2625 | CAAGUUCAAGCAA | 2626 | UUGCUUGAACUUGUCAUAG | n/a |
| 18472 | 1222 | 2627 | CAGAGUACACACA | 2628 | UGUGUGUACUCUGCUUGAA | 45% |
| 18473 | 1228 | 2629 | ACACACAGCAUAA | 2630 | UUAUGCUGUGUGUACUCUG | 36% |
| 18474 | 1233 | 2631 | CAGCAUAUAUAUA | 2632 | UAUAUAUGCUGUGUGUA | 68% |
| 18475 | 1218 | 2633 | UCAAGCAGAGUAA | 2634 | UUACUCUGCUUGAACUUGU | 64% |
| 18476 | 1235 | 2635 | AGCAUAUAUAUGA | 2636 | UCAUAUAUAUGCUGUGUGU | 78% |
| 18477 | 1225 | 2637 | AGAGUACACACAA | 2638 | UUGUGUGUACUCUGCUUGA | 92% |

TABLE 17-continued

Inhibition of gene expression with TGFB1 sd-rxRNA sequences
(Accession Number NM_000660.3)

| Oligo Number | Start Site | SEQ ID NO | Sense sequence | SEQ ID NO | Antisense sequence | % remaining expression (1 uM A549) |
|---|---|---|---|---|---|---|
| 18478 | 1221 | 2639 | AAGCAGAGUACAA | 2640 | UUGUACUCUGCUUG AACUU | 103% |
| 18479 | 1244 | 2641 | UUCAACACAUCAA | 2642 | UUGAUGUGUUGAA GAACAU | 84% |
| 18480 | 1224 | 2643 | AGCAGAGUACACA | 2644 | UGUGUACUCUGCUU GAACU | 37% |
| 18481 | 1242 | 2645 | AUAUAUGUUCUUA | 2646 | UAAGAACAUAUAUA UGCUG | 62% |
| 18482 | 1213 | 2647 | GACAAGUUCAAGA | 2648 | UCUUGAACUUGUCA UAGAU | 47% |
| 18483 | 1760 | 2649 | UUAAAGAUGGAGA | 2650 | UCUCCAUCUUUAAU GGGGC | 69% |
| 18484 | 1211 | 2651 | CUAUGACAAGUUA | 2652 | UAACUUGUCAUAGA UUUCG | n/a |
| 19411 | 1212 | 2653 | CAACGAAAUCUAA | 2654 | UUAGAUUUCGUUG UGGGUU | 52% |
| 19412 | 1222 | 2655 | UAUGACAAGUUCA | 2656 | UGAACUUGUCAUAG AUUUC | 51% |
| 19413 | 1228 | 2657 | AAGUUCAAGCAGA | 2658 | UCUGCUUGAACUUG UCAUA | n/a |
| 19414 | 1233 | 2659 | CAAGCAGAGUACA | 2660 | UGUACUCUGCUUGA ACUUG | 41% |
| 19415 | 1218 | 2661 | AAUCUAUGACAAA | 2662 | UUUGUCAUAGAUU UCGUUG | 104% |
| 19416 | 1244 | 2663 | CACACAGCAUAUA | 2664 | UAUAUGCUGUGUG UACUCU | 31% |

TABLE 18

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14084 | 1025 | 2665 | mC.mU.mC. A.mU. G. A. A.mU.mU. A. G. A.Chl | 2666 | P.mU.fC.fU. A. A.fU.fU.fC. A.fU. G. A. G* A* A* A*mU* A* C. | 61% |
| 14085 | 1049 | 2667 | mC.mU. G. A. G. G.mU.mC. A. A.mU.mU. A.Chl | 2668 | P.mU. A. A.fU.fU. G. A.fC.fC.fU.mC. A. G* A* A* G* A*mU* G. | 50% |
| 14086 | 1051 | 2669 | G. A. G. G.mU.mC. A. A.mU.mU. A. A. A.Chl | 2670 | P.mU.fU.fU. A. A.fU.fU. G. A.fC.mC.mU.mC* A* G* A* A* G* A. | n/a |
| 14087 | 1048 | 2671 | mU.mC.mU. G. A. G. G.mU.mC. A. A.mU.mU.Chl | 2672 | P.mA. A.fU.fU. G. A.fC.fC.fU.fC. A. G. A* A* G* A*mU* G* C. | 69% |
| 14088 | 1050 | 2673 | mU. G. A. G. G.mU.mC. A. A.mU.mU. A. A.Chl | 2674 | P.mU.fU. A. A.fU.fU. G. A.fC.fC.mU.mC. A* G* A* A* G* A* U. | 76% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14089 | 1047 | 2675 | mU.mU.mC.mU. G. A. G. G.mU.mC. A. A.mU.Chl | 2676 | P.mA.fU.fU. G. A.fC.fC.fU.fC. A. G. A. A* G* A*mU* G*mC* A. | 60% |
| 14090 | 800 | 2677 | G.mU.mC. A. G.mC.mU. G. G. A.mU. G. A.Chl | 2678 | P.mU.fC. A.fU.fC.fC. A. G.fC.fU. G. A.mC*mU*mC* G*mU*mU* U. | 71% |
| 14091 | 492 | 2679 | mU.mU.mC.mU. G. A.mU. G. A. A.mU.mC.mU.Chl | 2680 | P.mA. G. A.fU.fU.fC. A.fU.fC. A. G. A. A*mU* G* G*mU* G* A. | n/a |
| 14092 | 612 | 2681 | mU. G. G. A.mC.mU. G. A. G. G.mU.mC. A.Chl | 2682 | P.mU. G. A.fC.fC.fU.fC. A. G.fU.mC.mC. A*mU* A* A* A*mC* C. | n/a |
| 14093 | 481 | 2683 | G. A. G.mU.mC.mU.mC. A.mC.mC. A.mU.mU.Chl | 2684 | P.mA. A.fU. G. G.fU. G. A. G. A.mC.mU.mC* A*mU*mC* A* G* A. | n/a |
| 14094 | 614 | 2685 | G. A.mC.mU. G. A. G. G.mU.mC. A. A. A.Chl | 2686 | P.mU.fU.fU. G. A.fC.fC.fU.fC. A. G.mU.mC*mC* A*mU* A* A. | n/a |
| 14095 | 951 | 2687 | mU.mC. A.mC. A. G.mC.mC. A.mU. G. A. A.Chl | 2688 | P.mU.fU.fC. A.fU. G. G.fC.fU. G.mU. G. A* A* A*mU*mU*mC* A. | 89% |
| 14096 | 482 | 2689 | A. G.mU.mC.mU.mC. A.mC.mC. A.mU.mU.mC.Chl | 2690 | P.mG. A. A.fU. G. G.fU. G. A. G. A.mC.mU*mC* A*mU*mC* A* G. | 87% |
| 14097 | 856 | 2691 | A. A. G.mC. G. G. A. A. A. G.mC.mC. A.Chl | 2692 | P.mU. G. G.fC.fU.fU.fC.fC. G.mC.mU.mU* A*mU* A*mU* A* A. | 88% |
| 14098 | 857 | 2693 | A. G.mC. G. G. A. A. A. G.mC.mC. A. A.Chl | 2694 | P.mU.fU. G. G.fC.fU.fU.fU.fC.fC. G.mC.mU*mU* A*mU* A*mU* A. | 113% |
| 14099 | 365 | 2695 | A.mC.mC. A.mC. A.mU. G. G. A.mU. G. A.Chl | 2696 | P.mU.fC. A.fU.fC.fC. A.fU. G.fU. G. G.mU*mC* A*mU* G* G* C. | 98% |
| 14100 | 359 | 2697 | G.mC.mC. A.mU. G. A.mC.mC. A.mC. A.mU.Chl | 2698 | P.mA.fU. G.fU. G. G.fU.fC. A.fU. G. G.mC*mU*mU*mU*mC* G* U. | 84% |
| 14101 | 357 | 2699 | A. A. G.mC.mC. A.mU. G. A.mC.mC. A.mC.Chl | 2700 | P.mG.fU. G. G.fU.fC. A.fU. G. G.mC.mU.mU*mU*mU*mC * G*mU*mU* G. | 88% |
| 14102 | 858 | 2701 | G.mC. G. G. A. A. A. G.mC.mC. A. A.mU.Chl | 2702 | P.mA.fU.fU. G. G.fC.fU.fU.fU.fU.fC.mC. G.mC*mU*mU* A*mU* A* U. | n/a |
| 14103 | 1012 | 2703 | A. A. A.mU.mU.mU.mC. G.mU. A.mU.mU.mU.Chl | 2704 | P.mA. A. A.fU. A.fC. G. A. A. A.mU.mU.mU*mC* A* G* G*mU* G. | 93% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14104 | 1014 | 2705 | A.mU.mU.mU.mC. G.mU. A.mU.mU.mU.mC.m U.Chl | 2706 | P.mA. G. A. A. A.fU. A.fC. G. A. A. A.mU*mU*mU*mC* A* G* G. | 89% |
| 14105 | 356 | 2707 | A. A. A. G.mC.mC. A.mU. G. A.mC.mC. A.Chl | 2708 | P.mU. G. G.fU.fC. A.fU. G. G.fC.mU.mU.mU*mC* G*mU*mU* G* G. | 85% |
| 14106 | 368 | 2709 | A.mC. A.mU. G. G. A.mU. G. A.mU. A.mU.Chl | 2710 | P.mA.fU. A.fU.fC. A.fU.fC.fC. A.mU. G.mU* G* G*mU*mC* A* U. | 67% |
| 14107 | 1011 | 2711 | G. A. A. A.mU.mU.mU.mC. G.mU. A.mU.mU.Chl | 2712 | P.mA. A.fU. A.fC. G. A. A. A.fU.mU.mU.mC* A* G* G*mU* G* U. | 87% |
| 14108 | 754 | 2713 | G.mC. G.mC.mC.mU.mU.m C.mU. G. A.mU.mU.Chl | 2714 | P.mA. A.fU.fC. A. G. A. A. G. G.mC. G.mC* G*mU*mU*mC* A* G. | 73% |
| 14109 | 1021 | 2715 | A.mU.mU.mU.mC.m U.mC. A.mU. G. A. A.mU.Chl | 2716 | P.mA.fU.fU.fC. A.fU. G. A. G. A. A. A.mU* A*mC* G* A* A* A. | 128% |
| 14110 | 1330 | 2717 | mC.mU.mC.mU.mC. A.mU. G. A. A.mU. A. G.Chl | 2718 | P.mC.fU. A.fU.fU.fC. A.fU. G. A. G. A. G* A* A*mU* A* A* C. | 101% |
| 14111 | 346 | 2719 | A. A. G.mU.mC.mC. A. A.mC. G. A. A. A.Chl | 2720 | P.mU.fU.fU.fC. G.fU.fU. G. G. A.mC.mU.mU* A*mC*mU*mU* G* G. | 59% |
| 14112 | 869 | 2721 | A.mU. G. A.mU. G. A. G. A. G.mC. A. A.Chl | 2722 | P.mU.fU. G.fC.fU.fC.fU.fC. A.fU.mC. A.mU*mU* G* G*mC*mU* U. | 89% |
| 14113 | 701 | 2723 | G.mC. G. A. G. G. A. G.mU.mU. G. A. A.Chl | 2724 | P.mU.fU.fC. A. A.fC.fU.fC.fC.fU.mC. G.mC*mU*mU*mU*m C*mC* A. | 95% |
| 14114 | 896 | 2725 | mU. G. A.mU.mU. G. A.mU. A. G.mU.mC. A.Chl | 2726 | P.mU. G. A.fC.fU. A.fU.fC. A. A.mU.mC. A*mC* A*mU*mC* G* G. | 87% |
| 14115 | 1035 | 2727 | A. G. A.mU. A. G.mU. G.mC. A.mU.mC.mU.Chl | 2728 | P.mA. G. A.fU. G.fC. A.fC.fU. A.mU.mC.mU* A* A*mU*mU*mC* A. | 82% |
| 14116 | 1170 | 2729 | A.mU. G.mU. G.mU. A.mU.mC.mU. A.mU.mU.Chl | 2730 | P.mA. A.fU. A. G. A.fU. A.fC. A.mC. A.mU*mU*mC* A* A*mC* C. | 36% |
| 14117 | 1282 | 2731 | mU.mU.mC.mU. A.mU. A. G. A. A. G. A. A.Chl | 2732 | P.mU.fU.fC.fU.fU.fC.fU. A.fU. A. G. A. A*mU* G* A* A*mC* A. | 91% |
| 14118 | 1537 | 2733 | mU.mU. G.mU.mC.mC. A. G.mC. A. A.mU.mU.Chl | 2734 | P.mA. A.fU.fU. G.fC.fU. G. G. A.mC. A. A*mC*mC* G*mU* G* G. | 152% |
| 14119 | 692 | 2735 | A.mC. A.mU. G. G. A. A. A. G. C.mG. A.Chl | 2736 | P.mU.fC. G.fC.fU.fU.fU.fC.fC. A.mU. G.mU* G*mU* G* A* G* G. | n/a |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14120 | 840 | 2737 | G.mC. A. G.mU.mC.mC. A. G. A.mU.mU. A.Chl | 2738 | P.mU. A. A.fU.fC.fU. G. G. A.fC.mU. G.mC*mU*mU* G*mU* G* G. | 87% |
| 14121 | 1163 | 2739 | mU. G. G.mU.mU. G. A. A.mU. G.mU. G.mU.Chl | 2740 | P.mA.fC. A.fC. A.fU.fU.fC. A. A.mC.mC. A* A*mU* A* A* A* C. | 31% |
| 14122 | 789 | 2741 | mU.mU. A.mU. G. A. A. A.mC. G. A. G.mU.Chl | 2742 | P.mA.fC.fU.fC. G.fU.fU.fU.fC. A.mU. A. A*mC*mU* G*mU*mC* C. | 96% |
| 14123 | 841 | 2743 | mC. A. G.mU.mC.mC. A. G. A.mU.mU. A.mU.Chl | 2744 | P.mA.fU. A. A.fU.fC.fU. G. G. A.mC.mU. G*mC*mU*mU* G*mU* G. | 110% |
| 14124 | 852 | 2745 | A.mU. A.mU. A. A. G.mC. G. G. A. A. A.Chl | 2746 | P.mU.fU.fU.fC.fC. G.fC.fU.fU. A.mU. A.mU* A* A*mU*mC*mU* G. | 91% |
| 14125 | 209 | 2747 | mU. A.mC.mC. A. G.mU.mU. A. A. A.mC. A.Chl | 2748 | P.mU. G.fU.fU.fU. A. A.fC.fU. G. G.mU. A*mU* G* G*mC* A* C. | 110% |
| 14126 | 1276 | 2749 | mU. G.mU.mU.mC. A.mU.mU.mC.mU. A.mU. A.Chl | 2750 | P.mU. A.fU. A. G. A. A.fU. G. A. A.mC. A*mU* A* G* A*mC* A. | n/a |
| 14127 | 137 | 2751 | mC.mC. G. A.mC.mC. A. A. G. G. A. A. A.Chl | 2752 | P.mU.fU.fU.fC.fC.fU.fU. G. G.fU.mC. G. G*mC* G*mU*mU*mU* G. | 71% |
| 14128 | 711 | 2753 | G. A. A.mU. G. G.mU. G.mC. A.mU. A.mC.Chl | 2754 | P.mG.fU. A.fU. G.fC. A.fC.fC. A.mU.mU.mC A* A*mC*mU*mC* C. | 115% |
| 14129 | 582 | 2755 | A.mU. A.mU. G. A.mU. G. G.mC.mC. G. A.Chl | 2756 | P.mU.fC. G. G.fC.fC. A.fU.fC. A.mU. A.mU* G*mU* G*mU*mC* U. | 97% |
| 14130 | 839 | 2757 | A. G.mC. A. G.mU.mC.mC. A. G. A.mU.mU.Chl | 2758 | P.mA. A.fU.fC.fU. G. G. A.fC.fU. G.mC.mU*mU* G*mU* G* G* C. | 102% |
| 14131 | 1091 | 2759 | G.mC. A.mU.mU.mU. A. G.mU.mC. A. A. A.Chl | 2760 | P.mU.fU.fU. G. A.fC.fU. A. A. A.mU. G.mC* A* A* A* G*mU* G. | 10% |
| 14132 | 884 | 2761 | A. G.mC. A.mU.mU.mC.mC. G. A.mU. G.mU.Chl | 2762 | P.mA.fC. A.fU.fC. G. G. A. A.fU. G.mC.mU*mC* A*mU*mU* G* C. | 93% |
| 14133 | 903 | 2763 | mU. A. G.mU.mC. A. G. G. A. A.mC.mU.mU.Chl | 2764 | P.mA. A. G.fU.fU.fC.fC.fU. G. A.mC.mU. A*mU*mC* A* A*mU* C. | 97% |
| 14134 | 1090 | 2765 | mU. G.mC. A.mU.mU.mU. A. G.mU.mC. A. A.Chl | 2766 | P.mU.fU. G. A.fC.fU. A. A. A.fU. G.mC. A* A* A* G*mU* G* A. | 39% |
| 14135 | 474 | 2767 | G.mU.mC.mU. G. A.mU. G. A. G.mU.mC.mU.Chl | 2768 | P.mA. G. A.fC.fU.fC. A.fU.fC. A. G. A.mC*mU* G* G*mU* G* A. | 99% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14136 | 575 | 2769 | mU. A. G. A.mC. A.mC. A.mU. A.mU. G. A.Chl | 2770 | P.mU.fC. A.fU. A.fU. G.fU. G.fU.mC.mU. A*mC*mU* G*mU* G* G. | 108% |
| 14137 | 671 | 2771 | mC. A. G. A.mC. G. A. G. G. A.mC. A.mU.Chl | 2772 | P.mA.fU. G.fU.fC.fC.fU.fC. G.fU.mC.mU. G*mU* A* G*mC* A* U. | 98% |
| 14138 | 924 | 2773 | mC. A. G.mC.mC. G.mU. G. A. A.mU.mU.mC.Chl | 2774 | P.mG. A. A.fU.fU.fC. A.fC. G. G.mC.mU. G* A*mC*mU*mU*mU* G. | 100% |
| 14139 | 1185 | 2775 | A. G.mU.mC.mU. G. G. A. A.mU. A. A.Chl | 2776 | P.mU.fU. A.fU.fU.fU.fC.fC. A. G. A.mC.mU*mC* A* A* A*mU* A. | 47% |
| 14140 | 1221 | 2777 | A. G.mU.mU.mU. G.mU. G. G.mC.mU.mU.mC.Chl | 2778 | P.mG. A. A. G.fC.fC. A.fC. A. A. A.mC.mU* A* A* A*mC*mU* A. | 100% |
| 14141 | 347 | 2779 | A. G.mU.mC.mC. A. A.mC. G. A. A. A. G.Chl | 2780 | P.mC.fU.fU.fU.fC. G.fU.fU. G. G. A.mC.mU*mU* A*mC*mU*mU* G. | 103% |
| 14142 | 634 | 2781 | A. A. G.mU.mU.mU.mC. G.mC. A. G. A.mC.Chl | 2782 | P.mG.fU.fC.fU. G.fC. G. A. A. A.mC.mU.mU*mC*mU *mU* A* G* A. | 100% |
| 14143 | 877 | 2783 | A. G.mC. A. A.mU. G. A. G.mC. A.mU.mU.Chl | 2784 | P.mA. A.fU. G.fC.fU.fC. A.fU.fU. G.mC.mU*mC*mU*mC * A*mU* C. | 104% |
| 14144 | 1033 | 2785 | mU.mU. A. G. A.mU. A. G.mU. G.mC. A.mU.Chl | 2786 | P.mA.fU. G.fC. A.fC.fU. A.fU.fC.mU. A. A*mU*mU*mC* A*mU* G. | 95% |
| 14145 | 714 | 2787 | mU. G. G.mU. G.mC. A.mU. A.mC. A. A. G.Chl | 2788 | P.mC.fU.fU. G.fU. A.fU. G.fC. A.mC.mC. A*mU*mU*mC* A* A* C. | 101% |
| 14146 | 791 | 2789 | A.mU. G. A. A. A.mC. G. A. G.mU.mC. A.Chl | 2790 | P.mU. G. A.fC.fU.fC. G.fU.fU.fU.mC. A.mU* A* A*mC*mU* G* U. | 100% |
| 14147 | 813 | 2791 | mC.mC. A. G. A. G.mU. G.mC.mU. G. A. A.Chl | 2792 | P.mU.fU.fC. A. G.fC. A.fC.fU.fC.mU. G. G*mU*mC* A*mU*mC* C. | 97% |
| 14148 | 939 | 2793 | mC. A. G.mC.mC. A.mU. G. A. A.mU.mU.mU.Chl | 2794 | P.mA. A. A.fU.fU.fC. A.fU. G. G.mC.mU. G*mU* G* G* A* A* U. | 109% |
| 14149 | 1161 | 2795 | A.mU.mU. G. G.mU.mU. G. A. A.mU. G.mU.Chl | 2796 | P.mA.fC. A.fU.fU.fC. A. A.fC.fC. A. A.mU* A* A* A*mC*mU* G. | 34% |
| 14150 | 1164 | 2797 | G. G.mU.mU. G. A. A.mU. G.mU. G.mU. A.Chl | 2798 | P.m U. A.fC. A.fC. A.fU.fU.fC. A. A.mC.mC* A* A*mU* A* A. | n/a |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14151 | 1190 | 2799 | G. G. A. A. A.mU. A. A.mC.mU. A. A.mU.Chl | 2800 | P.mA.fU.fU. A. G.fU.fU. A.fU.fU.mU.mC.mC* A* G* A*mC*mU* C. | n/a |
| 14152 | 1333 | 2801 | mU.mC. A.mU. G. A. A.mU. A. A. G. A. A. A.Chl | 2802 | P.mU.fU.fU.fC.fU. A.fU.fU.fC. A.mU. G. A* G* A* G* A* A* U. | 31% |
| 14153 | 537 | 2803 | G.mC.mC. A. G.mC. A. A.mC.mC. G. A. A.Chl | 2804 | P.mU.fU.fC. G. G.fU.fU. G.fC.fU. G. G.mC* A* G* G*mU*mC* C. | n/a |
| 14154 | 684 | 2805 | mC. A.mC.mC.mU.mC. A.mC. A.mC. A.mU. G.Chl | 2806 | P.mC. A.fU. G.fU. G.fU. G. A. G. G.mU. G* A*mU* G*mU*mC* C. | 100% |
| 14155 | 707 | 2807 | A. G.mU.mU. G. A. A.mU. G. G.mU. G.mC.Chl | 2808 | P.mG.fC. A.fC.fC. A.fU.fU.fC. A. A.mC.mU*mC*mC*mU *mC* G* C. | 99% |
| 14156 | 799 | 2809 | A. G.mU.mC. A. G.mC.mU. G. G. A.mU. G.Chl | 2810 | P.mC. A.fU.fC.fC. A. G.fC.fU. G. A.mC.mU*mC* G*mU*mU*mU* C. | 95% |
| 14157 | 853 | 2811 | mU. A.mU. A. A. G.mC. G. G. A. A. A. G.Chl | 2812 | P.mC.fU.fU.fU.fC.fC. G.fC.fU.fU. A.mU. A*mU* A* A*mU*mC* U. | 106% |
| 14158 | 888 | 2813 | mU.mU.mC.mC. G. A.mU. G.mU. G. A.mU.mU.Chl | 2814 | P.mA. A.fU.fC. A.fC. A.fU.fC. G. G. A. A*mU* G*mC*mU*mC* A. | 88% |
| 14159 | 1194 | 2815 | A.mU. A. A.mC.mU. A. A.mU. G.mU. G.mU.Chl | 2816 | P.mA.fC. A.fC. A.fU.fU. A. G.fU.mU. A.mU*mU*mU*mC*mC* A* G. | 95% |
| 14160 | 1279 | 2817 | mU.mC. A.mU.mU.mC.mU. A.mU. A. G. A. A.Chl | 2818 | P.mU.fU.fC.fU. A.fU. A. G. A. A.mU. G. A* A*mC* A*mU* A* G. | 15% |
| 14161 | 1300 | 2819 | A. A.mC.mU. A.mU.mC. A.mC.mU. G.mU. A.Chl | 2820 | P.mU. A.fC. A. G.fU. G. A.fU. A. G.mU.mU*mU* G*mC* A*mU* U. | 86% |
| 14162 | 1510 | 2821 | G.mU.mC. A. A.mU.mU. G.mC.mU.mU. A.mU.Chl | 2822 | P.mA.fU. A. A. G.fC. A. A.fU.fU. G. A.mC* A*mC*mC* A*mC* C. | 86% |
| 14163 | 1543 | 2823 | A. G.mC. A. A.mU.mU. A. A.mU. A. A. A.Chl | 2824 | P.mU.fU.fU. A.fU.fU. A. A.fU.fU. G.mC.mU* G* G* A*mC* A* A. | 110% |
| 14164 | 434 | 2825 | A.mC. G. A.mC.mU.mC.mU. G. A.mU. G. A.Chl | 2826 | P.mU.fC. A.fU.fC. A. G. A. G.fU.mC. G.mU*mU*mC* G* A* G* U. | 134% |
| 14165 | 600 | 2827 | mU. A. G.mU. G.mU. G. G.mU.mU.mU. A.mU.Chl | 2828 | P.mA.fU. A. A. A.fC.fC. A.fC. A.mC.mU. A*mU*mC* A*mC*mC* U. | 102% |
| 14166 | 863 | 2829 | A. A. G.mC.mC. A. A.mU. G. A.mU. G. A.Chl | 2830 | P.mU.fC. A.fU.fC. A.fU.fU. G. G.mC.mU.mU*mU*mC *mC* G*mC* U. | 93% |

TABLE 18-continued

Inhibition of gene expression with SPP1 sd-rxRNA sequences (Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14167 | 902 | 2831 | A.mU. A. G.mU.mC. A. G. G. A. A.mC.mU.Chl | 2832 | P.mA. G.fU.fU.fC.fC.fU. G. A.fC.mU. A.mU*mC* A* A*mU*mC* A. | 101% |
| 14168 | 921 | 2833 | A. G.mU.mC. A. G.mC.mC. G.mU. G. A. A.Chl | 2834 | P.mU.fU.fC. A.fC. G. G.fC.fU. G. A.mC.mU*mU*mU* G* G* A* A. | 98% |
| 14169 | 154 | 2835 | A.mC.mU. A.mC.mC. A.mU. G. A. G. A. A.Chl | 2836 | P.mU.fU.fC.fU.fC. A.fU. G. G.fU. A. G.mU* G* A* G*mU*mU* U. | n/a |
| 14170 | 217 | 2837 | A. A. A.mC. A. G. G.mC.mU. G. A.mU.mU.Chl | 2838 | P.mA. A.fU.fC. A. G.fC.fC.fU. G.mU.mU.mU* A* A*mC*mU* G* G. | 66% |
| 14171 | 816 | 2839 | G. A. G.mU. G.mC.mU. G. A. A. A.mC.mC.Chl | 2840 | P.mG. G.fU.fU.fU.fC. A. G.fC. A.mC.mU.mC*mU* G* G*mU*mC* A. | 102% |
| 14172 | 882 | 2841 | mU. G. A. G.mC. A.mU.mU.mC.mC. G. A.mU.Chl | 2842 | P.mA.fU.fC. G. G. A. A.fU. G.fC.mU.mC. A*mU*mU* G*mC*mU* C. | 103% |
| 14173 | 932 | 2843 | A. A.mU.mU.mC.mC. A.mC. A. G.mC.mC. A.Chl | 2844 | P.mU. G. G.fC.fU. G.fU. G. G. A. A.mU.mU*mC* A*mC* G* G* C. | n/a |
| 14174 | 1509 | 2845 | mU. G.mU.mC. A. A.mU.mU. G.mC.mU.mU. A.Chl | 2846 | P.mU. A. A. G.fC. A. A.fU.fU. G. A.mC. A*mC*mC* A*mC*mC* A. | n/a |
| 14175 | 157 | 2847 | A.mC.mC. A.mU. G. A. G. A. A.mU.mU. G.Chl | 2848 | P.mC. A. A.fU.fU.fC.fU.fC. A.fU. G. G.mU* A* G*mU* G* A* G. | 109% |
| 14176 | 350 | 2849 | mC.mC. A. A.mC. G. A. A. A. G.mC.mC. A.Chl | 2850 | P.mU. G. G.fC.fU.fU.fU.fC. G.fU.mU. G. G* A*mC*mU*mU* A* C. | 95% |
| 14177 | 511 | 2851 | mC.mU. G. G.mU.mC. A.mC.mU. G. A.mU.mU.Chl | 2852 | P.mA. A.fU.fC. A. G.fU. G. A.fC.mC. A. G*mU*mU*mC* A*mU* C. | 100% |
| 14178 | 605 | 2853 | mU. G. G.mU.mU.mU. A.mU. G. G. A.mC.mU.Chl | 2854 | P.mA. G.fU.fC.fC. A.fU. A. A. A.mC.mC. A*mC* A*mC*mU* A* U. | 99% |
| 14179 | 811 | 2855 | G. A.mC.mC. A. G. A. G.mU. G.mC.mU. G.Chl | 2856 | P.mC. A. G.fC. A.fC.fU.fC.fU. G. G.mU.mC* A*mU*mC*mC* A* G. | 88% |
| 14180 | 892 | 2857 | G. A.mU. G.mU. G. A.mU.mU. G. A.mU. A.Chl | 2858 | P.m U. A.fU.fC. A. A.fU.fC. A.fC. A.mU.mC* G* G* A* A*mU* G. | 76% |
| 14181 | 922 | 2859 | G.mU.mC. A. G.mC.mC. G.mU. G. A. A.mU.Chl | 2860 | P.mA.fU.fU.fC. A.fC. G. G.fC.fU. G. A.mC*mU*mU*mU* G* G* A. | 59% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 14182 | 1169 | 2861 | A. A.mU. G.mU. G.mU. A.mU.mC.mU. A.mU.Chl | 2862 | P.mA.fU. A. G. A.fU. A.fC. A.fC. A.mU.mU*mC* A* A*mC*mC* A. | 69% |
| 14183 | 1182 | 2863 | mU.mU. G. A. G.mU.mC.mU. G. G. A. A. A.Chl | 2864 | P.mU.fU.fU.fC.fC. A. G. A.fC.fU.mC. A. A* A*mU* A* G* A* U. | n/a |
| 14184 | 1539 | 2865 | G.mU.mC.mC. A. G.mC. A. A.mU.mU. A. A.Chl | 2866 | P.mU.fU. A. A.fU.fU. G.fC.fU. G. G. A.mC* A* A*mC*mC* G* U. | 77% |
| 14185 | 1541 | 2867 | mC.mC. A. G.mC. A. A.mU.mU. A. A.mU. A.Chl | 2868 | P.mU. A.fU.fU. A. A.fU.fU. G.fC.mU. G. G* A*mC* A* A*mC* C. | n/a |
| 14186 | 427 | 2869 | G. A.mC.mU.mC. G. A. A.mC. G. A.mC.mU.Chl | 2870 | P.mA. G.fU.fC. G.fU.fU.fC. G. A. G.mU.mC* A* A*mU* G* G* A. | 69% |
| 14187 | 533 | 2871 | A.mC.mC.mU. G.mC.mC. A. G.mC. A. A.mC.Chl | 2872 | P.mG.fU.fU. G.fC.fU. G. G.fC. A. G. G.mU*mC*mC* G*mU* G* G. | 78% |
| 18538 | 496 | 2873 | G. A.mU. G. A. A.mU.mC.mU. G. A.mU. A.Chl | 2874 | P.mU. A.fU.fC. A. G. A.fU.fU.fC. A.fU.fC* A* G* A* A*fU* G. | 74% |
| 18539 | 496 | 2875 | mU. G. A.mU. G. A. A.mU.mC.mU. G. A.mU. A.Chl | 2876 | P.mU. A.fU.fC. A. G. A.fU.fU.fC. A.fU.fC* A* G* A* A*fU* G. | 72% |
| 18540 | 175 | 2877 | A.mU.mU.mU. G.mC.mU.mU.mU.mU. G.mC. A.Chl | 2878 | P.mU. G.fC. A. A. A. A. G.fC. A. A. A.fU*fC* A*fC*fU*fG* C. | 98% |
| 18541 | 175 | 2879 | G. A.mU.mU.mU. G.mC.mU.mU.mU.mU. G.mC. A.Chl | 2880 | P.mU. G.fC. A. A. A. A. G.fC. A. A. A.fU*fC* A*fC*fU*fG* C. | 28% |
| 18542 | 172 | 2881 | G.mU. G. A.mU.mU.mU. G.mC.mU.mU.mU. A.Chl | 2882 | P.mU. A. A. A. G.fC. A. A. A.fU.fC. A.fC*fU* G*fC* A* A* U. | 24% |
| 18543 | 172 | 2883 | A. G.mU. G. A.mU.mU.mU. G.mC.mU.mU.mU. A.Chl | 2884 | P.mU. A. A. A. G.fC. A. A. A.fU.fC. A.fC*fU* G*fC* A* A* U. | 14% |
| 18544 | 1013 | 2885 | A. A.mU.mU.mU.mC. G.mU. A.mU.mU.mU. A.Chl | 2886 | P.mU. A. A. A.fU. A.fC. G. A. A. A.fU.fU*fU*fC* A* G* G* U. | 100% |
| 18545 | 1013 | 2887 | A. A. A.mU.mU.mU.mC. G.mU. A.mU.mU.mU. A.Chl | 2888 | P.mU. A. A. A.fU. A.fC. G. A. A. A.fU.fU*fU*fC* A* G* G* U. | 109% |
| 18546 | 952 | 2889 | mC. A.mC. A. G.mC.mC. A.mU. G. A. A. A.Chl | 2890 | P.mU.fU.fU. C. A.fU. G. G.fC.fU. G.fU. G* A* A*fU*fU* C. | 32% |
| 18547 | 952 | 2891 | mU.mC. A.mC. A. G.mC.mC. A.mU. G. A. A. A.Chl | 2892 | P.mU.fU.fU. C. A.fU. G. G.fC.fU. G.fU. G* A* A*fU*fU* C. | 33% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 18548 | 174 | 2893 | G. A.mU.mU.mU. G.mC.mU.mU.mU.m U. G. A.Chl | 2894 | P.mU.fC. A. A. A. A. G.fC. A. A. A.fU.fC* A*fC*fU* G*fC* A. | 57% |
| 18549 | 174 | 2895 | mU. G. A.mU.mU.mU. G.mC.mU.mU.mU.m U. G. A.Chl | 2896 | P.mU.fC. A. A. A. A. G.fC. A. A. A.fU.fC* A*fC*fU* G*fC* A. | 53% |
| 18550 | 177 | 2897 | mU.mU. G.mC.mU.mU.mU.m U. G.mC.mC.mU. A.Chl | 2898 | P.mU. A. G. G.fC. A. A. A. A. G.fC. A. A* A*fU*fC* A*fC* U. | 97% |
| 18551 | 177 | 2899 | mU.mU.mU. G.mC.mU.mU.mU.m U. G.mC.mC.mU. A.Chl | 2900 | P.mU. A. G. G.fC. A. A. A. A. G.fC. A. A* A*fU*fC* A*fC* U. | 103% |
| 18552 | 1150 | 2901 | mU.mU.mU.mC.mU. mC. A. G.mU.mU.mU. A. A.Chl | 2902 | P.mU.fU. A. A. A.fC.fU. G. A. G. A. A. A* G* A* A* G*fC* A. | 96% |
| 18553 | 1089 | 2903 | mU.mU. G.mC. A.mU.mU.mU. A. G.mU.mC. A.Chl | 2904 | P.mU. G. A.fC.fU. A. A. A.fU. G.fC. A. A* A* G*fU* G* A* G. | 94% |
| 18554 | 1086 | 2905 | A.mC.mU.mU.mU. G.mC. A.mU.mU.mU. A. A.Chl | 2906 | P.mU.fU. A. A. A.fU. G.fC. A. A. A. G.fU* G* A* G* A* A* A. | n/a |
| 18555 | 1093 | 2907 | A.mU.mU.mU. A. G.mU.mC. A. A. A. A. A.Chl | 2908 | P.mU.fU.fU.fU.fU. G. A.fC.fU. A. A. A.fU* G*fC* A* A* A* G. | n/a |
| 18556 | 1147 | 2909 | mU.mU.mC.mU.mU. mU.mC.mU.mC. A. G.mU. A.Chl | 2910 | P.mU. A.fC.fU. G. A. G. A. A. A. G. A. A* G*fC* A*fU*fU* U. | n/a |
| 18557 | 1148 | 2911 | mU.mC.mU.mU.mU. mC.mU.mC. A. G.mU.mU. A.Chl | 2912 | P.mU. A. A.fC.fU. G. A. G. A. A. A. G. A* A* G*fC* A*fU* U. | 66% |
| 18558 | 1128 | 2913 | G. A. A. A. G. A. G. A. A.mC. A.mU. A.Chl | 2914 | P.mU. A.fU. G.fU.fU.fC.fU.fC.fU.fU.f U.fC* A*fU*fU*fU*fU* G. | 16% |
| 18559 | 1087 | 2915 | mC.mU.mU.mU. G.mC. A.mU.mU.mU. A. G. A.Chl | 2916 | P.mU.fC.fU. A. A. A.fU. G.fC. A. A. A. G*fU* G* A* G* A. | 28% |
| 18560 | 1088 | 2917 | mU.mU.mU. G.mC. A.mU.mU.mU. A. G.mU. A.Chl | 2918 | P.mU. A.fC.fU. A. A. A.fU. G.fC. A. A* G*fU* G* A* G* A. | n/a |
| 18561 | 1083 | 2919 | mC.mU.mC. A.mC.mU.mU.mU. G.mC. A.mU. A.Chl | 2920 | P.mU. A.fU. G.fC. A. A. A. G.fU. G. A. G* A* A* A*fU*fU* G. | 53% |
| 18562 | 1081 | 2921 | mU.mU.mC.mU.mC. A.mC.mU.mU.mU. G.mC. A.Chl | 2922 | P.mU. G.fC. A. A. A. G.fU. G. A. G. A* A*fU*fU* G*fU* A. | 89% |
| 18563 | 555 | 2923 | mC. A.mC.mU.mC.mC. A. G.mU.mU. G.mU. A.Chl | 2924 | P.mU. A.fC. A. A.fC.fU. G. G. A. G.fU. G* A* A* A* A*fC*fU. | 33% |

TABLE 18-continued

Inhibition of gene expression with SPP1 sd-rxRNA sequences
(Accession Number NM_000582.2)

| Oligo Number | Start Site | SEQ ID NO | Sense sequence | SEQ ID NO | Antisense sequence | % remaining expression (1 uM A549) |
|---|---|---|---|---|---|---|
| 18564 | 1125 | 2925 | A. A.mU. G. A. A. A. G. A. G. A. A. A.Chl | 2926 | P.mU.fU.fU.fC.fU.fC.fU. fU.fU.fC. A.fU.fU*fU*fU* G*fC*fU* A. | n/a |
| 18565 | 168 | 2927 | mU. G.mC. A. G.mU. G. A.mU.mU.mU.mG. A.Chl | 2928 | P.mU.fC. A. A. A.fU.fC. A.fC.fU. G.fC. A* A*fU*fU*fC*fU* C. | 14% |
| 18566 | 1127 | 2929 | mU. G. A. A. G. A. G. A. A.mC. A. A.Chl | 2930 | P.mU.fU. G.fU.fU.fC.fU.fC.fU.fU.f U.fC. A*fU*fU*fU*fU* G* C. | 27% |
| 18567 | 1007 | 2931 | A.mC.mC.mU. G. A. A. A.mU.mU.mU.mC. A.Chl | 2932 | P.mU. G. A. A. A.fU.fU.fU.fC. A. G. G.fU* G*fU*fU*fU* A* U. | 129% |
| 18568 | 164 | 2933 | G. A. A.mU.mU. G.mC. A. G.mU. G. A. A.Chl | 2934 | P.mU.fC. A.fC.fU. G.fC. A. A.fU.fU.fC*fU*fC* A*fU* G* G. | 47% |
| 18569 | 222 | 2935 | G. G.mC.mU. G. A.mU.mU.mC.mU. G. G. A.Chl | 2936 | P.mU.fC.fC. A. G. A. A.fU.fC. A. G.fC.fC*fU* G*fU*fU*fU* A. | n/a |
| 20612 | 172 | 2937 | A. G.mU. G. A.mU.mU.mU. G.mC.mU.mU.mU. A.Chl | 2938 | P.mU. A. A. A. G.fC. A. A. A.fU.mC. A.mC*mU* G*mC* A* A* U. | n/a |
| 20613 | 172 | 2939 | A. G.mU. G. A.mU.mU.mU. G.mC.mU.mU.mU. A.Chl | 2940 | P.mU. A. A. A. G.fC. A. A. A.fU.fC. A.mC*fU* G*mC* A* A* U. | n/a |
| 20614 | 172 | 2941 | A. G.mU. G. A.mU.mU.mU. G.mC.mU.mU.mU. A.Chl | 2942 | P.mU. A. A. A. G. C. A. A. A. U.mC. A.mC*mU* G*mC* A* A* U. | 101% |
| 20615 | 172 | 2943 | A. G.mU. G. A.mU.mU.mU. G.mC.mU.mU.mU. A.Chl | 2944 | P.mU. A. A. A. G.fC. A. A. A.fU.mC. A.mC*mU*mG*mC*mA*mA* U. | 104% |

TABLE 19

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | % remaining expression (1 uM A549) |
|---|---|---|---|---|---|---|
| 14422 | 451 | 2945 | mC. A.mC. A.mU.mU.mU. G. A.mU.mU. G. A.Chl | 2946 | P.mU.fC. A. A.fU.fC. A. A.fU. G.mU. G* A*mU*mC*mU* G. | 72% |
| 14423 | 1769 | 2947 | mC. A.mC.mU. G.mC.mC.mU.mC. A. A.mU.mU.Chl | 2948 | P.mA. A.fU.fU. G. A. G. G.fC. A. G.mU. G*mU*mU* G* A*mU* G. | 71% |

TABLE 19-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 14424 | 1464 | 2949 | A. A. A.mU. A.mC.mC. A. G.mU.mC.mU.Chl | 2950 | P.mA. A. G. A.fC.fU. G. G.fU. A.mU.mU.mU*mC* A*mU*mC*mU* G. | 74% |
| 14425 | 453 | 2951 | mC. A.mU.mU.mU. G. A.mU.mU. G. A.mC. A.Chl | 2952 | P.mU. G.fU.fC. A. A.fU.fC. A. A. A.mU. G*mU* G* A*mU*mC* U. | 83% |

|  |  |  |  |  |  | % remaining expression (1 uM PC-3) |
|---|---|---|---|---|---|---|
| 17388 | 285 | 2953 | G. A. A. A. A.mC.mU. G.mC.mU.mC. A. A.Chl | 2954 | P.mU.fU. G. A. G.fC. A. G.fU.fU.fU.fU.fC*fU*fC *fC* A*fU* A. | 88% |
| 17389 | 520 | 2955 | A.mC.mC.mU.mC.m U.mC.mC.mU. A.mU.mU. A.Chl | 2956 | P.mU. A. A.fU. A. G. G. A. G. A. G. G.fU*fU* A* G* A* G* A. | 25% |
| 17390 | 467 | 2957 | mU.mC.mC. A.mC.mC. A. A.mC.mU.mU. A. A.Chl | 2958 | P.mU.fU. A. A. G.fU.fU. G. G.fU. G. G. A*fC*fU* G*fU*fC* A. | 68% |
| 17391 | 467 | 2959 | G.mU.mC.mC. A.mC.mC. A. A.mC.mU.mU. A. A.Chl | 2960 | P.mU.fU. A. A. G.fU.fU. G. G.fU. G. G. A*fC*fU* G*fU*fC* A. | 101% |
| 17392 | 524 | 2961 | mC.mU.mC.mC.mU. A.mU.mU. A.mU. A.mC. A.Chl | 2962 | P.mU. G.fU. A.fU. A. A.fU. A. G. G. A. G* A* G* G*fU*fU* A. | 49% |
| 17393 | 448 | 2963 | G. A.mU.mC. A.mC. A.mU.mU.mU. G. A. A.Chl | 2964 | P.mU.fU.fC. A. A. A.fU. G.fU. G. A.fU.fC*fU* G* G* A*fU* G. | 29% |
| 17394 | 448 | 2965 | A. G.mU.mC. A.mC. A.mU.mU.mU. G. A. A.Chl | 2966 | P.mU.fU.fC. A. A. A.fU. G.fU. G. A.fU.fC*fU* G* G* A*fU* G. | 31% |
| 17395 | 519 | 2967 | A. A.mC.mU.mC.m U.mC.mC.mU. A.mU. A.Chl | 2968 | P.mU. A.fU. A. G. G. A. G. A. G. G.fU.fU* A* G* A* G* A. | 12% |
| 17396 | 437 | 2969 | G.mU.mU. G. A.mC. A.mU.mC.mC. A. G. A.Chl | 2970 | P.mU.fC.fU. G. G. A.fU. G.fU.fC. A. A.fC* A*fC* A*fU* A. | 86% |
| 17397 | 406 | 2971 | mC.mC.mU.mU.mC. mC.mU.mU.mC. G. A. A. A.Chl | 2972 | P.mU.fU.fU.fC. G. A. A. G. G. A. A. G. G* G* A* A*fU* G* U. | 23% |
| 17398 | 339 | 2973 | A.mC.mU.mC.mC. A. A. A.mC. A.mC. A. A.Chl | 2974 | P.mU.fU. G.fU. G.fU.fU.fU. G. G. A. G.fU* G* G* G*fU*fU* U. | 102% |
| 17399 | 339 | 2975 | mC. A.mC.mU.mC.mC. A. A. A.mC. A.mC. A. A.Chl | 2976 | P.mU.fU. G.fU. G.fU.fU.fU. G. G. A. G.fU* G* G* G*fU*fU* U. | 55% |
| 17400 | 338 | 2977 | mC. A.mC.mU.mC.mC. A. A. A.mC. A.mC. A.Chl | 2978 | P.mU. G.fU. G.fU.fU.fU. G. G. A. G.fU. G* G* G*fU*fU*fU* C. | 62% |

TABLE 19-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 17401 | 468 | 2979 | mC.mC. A.mC.mC. A. A.mC.mU.mU. A.mC. A.Chl | 2980 | P.mU. G.fU. A. A. G.fU.fU. G. G.fU. G. G* A*fC*fU* G*fU* C. | 61% |
| 17402 | 468 | 2981 | mU.mC.mC. A.mC.mC. A. A.mC.mU.mU. A.mC. A.Chl | 2982 | P.mU. G.fU. A. A. G.fU.fU. G. G.fU. G. G* A*fC*fU* G*fU* C. | 179% |
| 17403 | 1465 | 2983 | A. A.mU. A.mC.mC. A. G.mU.mC.mU.mU. A.Chl | 2984 | P.mU. A. A. G. A.fC.fU. G. G.fU. A.fU.fU*fU*fC* A*fU*fC* U. | 30% |
| 17404 | 243 | 2985 | G. A.mC.mC. A. G.mU. A.mU. A. A. G. A.Chl | 2986 | P.mU.fC.fU.fU. A.fU. A.fC.fU. G. G.fU.fC* A* A* A*fU*fC* C. | 32% |
| 17405 | 1472 | 2987 | G.mU.mC.mU.mU.mU.mU. A. A.mU. G. A. A.Chl | 2988 | P.mU.fU.fC. A.fU.fU. A. A. A. G. A.fC*fU* G* G*fU* A* U. | 15% |
| 17406 | 2446 | 2989 | A. A.mU.mU.mU.mC. A.mU. G.mU.mC.mU. A.Chl | 2990 | P.mU. A. G. A.fC. A.fU. G. A. A. A.fU.fU* A*fC*fU* G* G* U. | 142% |
| 17407 | 449 | 2991 | A.mU.mC. A.mC. A.mU.mU.mU. G. A.mU. A.Chl | 2992 | P.mU. A.fU.fC. A. A. A.fU. G.fU. G. A.fU*fC*fU* G* G* A* U. | 54% |
| 17408 | 449 | 2993 | G. A.mU.mC. A.mC. A.mU.mU.mU. G. A.mU. A.Chl | 2994 | P.mU. A.fU.fC. A. A. A.fU. G.fU. G. A.fU*fC*fU* G* G* A* U. | 27% |
| 17409 | 444 | 2995 | mU.mC.mC. A. G. A.mU.mC. A.mC. A.mU. A.Chl | 2996 | P.mU. A.fU. G.fU. G. A.fU.fC.fU. G. G. A*fU* G*fU*fC* A* A. | 49% |
| 17410 | 1093 | 2997 | mU. A.mC.mU. G. A.mU. A. G. G. A. G. A.Chl | 2998 | P.mU.fC.fU.fC.fC.fU. A.fU.fC. A. G.fU. A*fU*fU* A* G*fC* C. | 32% |
| 17411 | 1134 | 2999 | G.mU. G.mC. A. A.mC. A.mC.mU.fU. G. A.Chl | 3000 | P.mU.fC. A. A. G.fU. G.fU.fU. G.mC. A.fC* A*fU* A* A*fU* C. | 70% |
| 17412 | 244 | 3001 | A.mC.mC. A. G.mU. A.mU. A. A. G.mU. A.Chl | 3002 | P.mU. A.fC.fU.fU. A.fU. A.fC.fU. G. G.fU*fC* A* A* A*fU* C. | 63% |
| 17413 | 1946 | 3003 | G. A. A. G.mU.mC.mU. A. A.mU. G. A. A.Chl | 3004 | P.mU.fU.fC. A.fU.fU. A. G. A.fC.mU.fU.fC*fU* A*fC* A* G* U. | 19% |
| 17414 | 638 | 3005 | A. A. G. A. A. G. A. A. A. G.mU.mU. A.Chl | 3006 | P.mU. A. A.fC.fU.fU.fU.fU.fC.fU.fU.fC.fU.fU* A* G* A* A* G* C. | 27% |
| 17415 | 450 | 3007 | mU.mC. A.mC. A.mU.mU.mU. G. A.mU.mU. A.Chl | 3008 | P.mU. A. A.fU.fC. A. A. A.fU. G.fU. G. A*fU*fC*fU* G* G* A. | 216% |
| 17416 | 450 | 3009 | A.mU.mC. A.mC. A.mU.mU.mU. G. A.mU.mU. A.Chl | 3010 | P.mU. A. A.fU.fC. A. A. A.fU. G.fU. G. A*fU*fC*fU* G* G* A. | 32% |
| 17417 | 452 | 3011 | A.mC. A.mC. A.mU.mU.mU. G. A.mU.mU. G. A. A.Chl | 3012 | P.mU.fU.fC. A. A.fU.fC. A. A. A.fU. G.fU* G* A*fU*fC*fU* G. | 99% |

TABLE 19-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 17418 | 452 | 3013 | mC. A.mC. A.mU.mU.mU. G. A.mU.mU. G. A. A.Chl | 3014 | P.mU.fU.fC. A. A.fU.fC. A. A. A.fU. G.fU* G* A*fU*fC*fU* G. | 54% |
| 17419 | 454 | 3015 | A.mU.mU.mU. G. A.mU.mU. G. A.mC. A. A.Chl | 3016 | P.mU.fU. G.fU.fC. A. A.fU.fC. A. A. A.fU* G*fU* G* A*fU* C. | 86% |
| 17420 | 454 | 3017 | mC. A.mU.mU.mU. G. A.mU.mU. G. A.mC. A. A.Chl | 3018 | P.mU.fU. G.fU.fC. A. A.fU.fC. A. A. A.fU* G*fU* G* A*fU* C. | 89% |
| 17421 | 1790 | 3019 | mC. A.mU.mC.mU. G.mC. A. A.mU. A. A. A.Chl | 3020 | P.mU.fU.fU. A.fU.fU. G.fC. A. G. A.fU. G* A* G* A* G* A* C. | 55% |
| 17422 | 1790 | 3021 | mU.mC. A.mU.mC.mU. G.mC. A. A.mU. A. A. A.Chl | 3022 | P.mU.fU.fU. A.fU.fU. G.fC. A. G. A.fU. G* A* G* A* G* A* C. | 62% |
| 21180 | 448 | 3023 | G. A.mU.mC. A.mC. A.mU.mU.mU. G. A. A.TEG-Chl | 3024 | P.mU.fU.fC. A.mA. A.fU. G.fU. G. A.mU.mC*mU* G* G* A*mU* G. | 76% |
| 21181 | 448 | 3025 | G. A.mU.mC. A.mC. A.mU.mU.mU. G. A. A.TEG-Chl | 3026 | P.mU.fU.fC. A.mA. A.fU. G.fU. G. A.fU.fC*fU*mG*mG*m A*fU* G. | 37% |
| 21182 | 448 | 3027 | G. A.mU.mC. A.mC. A.mU.mU.mU. G*mA*mA.TEG-Chl | 3028 | P.mU.fU.fC. A. A. A.fU. G.fU. G. A.fU.fC*fU* G* G* A*fU* G. | 29% |
| 21183 | 448 | 3029 | mG*mA*mU.mC. A.mC. A.mU.mU.mU. G*mA*mA.TEG-Chl | 3030 | P.mU.fU.fC. A. A. A.fU. G.fU. G. A.fU.C*fU* G* G* A*fU* G. | 46% |
| 21184 | 448 | 3031 | mG*mA*mU.mC.mA. mC.mA.mU.mU.mU mG*mA*mA.TEG-Chl | 3032 | P.mU.fU.fC. A. A. A.fU. G.fU. G. A.fU.fC*fU* G* G* A*fU* G. | 60% |
| 21185 | 449 | 3033 | G. A.mU.mC. A.mC. A.mU.mU.mU. G. A.mU. A.TEG-Chl | 3034 | P.mU. A.fU.fC. A. A. A.fU. G.fU. G. A.fU.fC*fU* G* G* A*fU* G. | 27% |
| 21186 | 449 | 3035 | G. A.mU.mC. A.mC. A.mU.mU.mU. G. A.mU. A.TEG-Chl | 3036 | P.mU. A.fU.fC. A. A. A.fU. G.fU. G. A.mU.mC*mU* G* G* A*mU* G. | 57% |
| 21187 | 449 | 3037 | G. A.mU.mC. A.mC. A.mU.mU.mU. G. A.mU. A.TEG-Chl | 3038 | P.m U. A.fU.fC. A.mA. A.fU. G.fU. G. A.mU.mC*mU* G* G* A*mU* G. | 54% |
| 21188 | 449 | 3039 | G. A.mU.mC. A.mC. A.mU.mU.mU. G. A.mU. A.TEG-Chl | 3040 | P.mU. A.fU.fC. A. A. A.fU. G.fU. G. A.mU.mC*mU*mG*mG *mA*mU* G. | 66% |
| 21189 | 449 | 3041 | G. A.mU.mC. A.mC. A.mU.mU.mU. G. A.mU. A.TEG-Chl | 3042 | P.m U. A.fU.fC. A.mA. A.fU. G.fU. G. A.mU.mC*mU*mG*mG *mA*mU* G. | 44% |
| 21190 | 449 | 3043 | G. A.mU.mC. A.mC. A.mU.mU.mU. G. A.mU. A.TEG-Chl | 3044 | P.mU. A.fU.fC. A. A. A.fU. G.fU. G. A.fU.fC*fU*mG*mG*m A*fU* G. | 52% |

TABLE 19-continued

Inhibition of gene expression with PTGS2 sd-rxRNA sequences
(Accession Number: NM_000963.2)

| Oligo Number | Start Site | SEQ ID NO | Sense sequence | SEQ ID NO | Antisense sequence | |
|---|---|---|---|---|---|---|
| 21191 | 449 | 3045 | G. A.mU.mC. A.mC. A.mU.mU.mU. G. A.mU. A.TEG-Chl | 3046 | P.m U. A.fU.fC. A.mA. A.fU. G.fU. G. A.fU.fC*fU*mG*mA*fU* G. | 41% |
| 21192 | 449 | 3047 | G. A.mU.mC. A.mC. A.mU.mU.mU. G. A.mU. A.TEG-Chl | 3048 | P.mU. A.fU.fC. A. A. A.fU. G.fU. G. A.fU.mC*fU*mG*mG*mA*fU* G. | 98% |
| 21193 | 449 | 3049 | G. A.mU.mC. A.mC. A.mU.mU.mU. G. A*mU*mA.TEG-Chl | 3050 | P.mU. A.fU.fC. A. A. A.fU. G.fU. G. A.fU*fC*fU* G* G* A* U. | 93% |
| 21194 | 449 | 3051 | mG*mA*mU.mC. A.mC. A.mU.mU.mU. G. A*mU*mA.TEG-Chl | 3052 | P.mU. A.fU.fC. A. A. A.fU. G.fU. G. A.fU*fC*fU* G* G* A* U. | 119% |
| 21195 | 449 | 3053 | mG*mA*mU.mC.mA. mC.mA.mU.mU.mU. mG.mA*mU*mA.TE G-Chl | 3054 | P.mU. A.fU.fC. A. A. A.fU. G.fU. G. A.fU*fC*fU* G* G* A* U. | 292% |
| 20620 | 449 | 3055 | G. A.mU.mC. A.mC. A.mU.mU.mU. G. A.mU. A.Chl-TEG | 3056 | P.mU. A.fU.fC. A. A. A.fU. G.fU. G. A.mU*mC*mU* G* G* A* U. | 24% |
| 20621 | 449 | 3057 | G. A.mU.mC. A.mC. A.mU.mU.mU. G. A.mU. A.Chl-TEG | 3058 | P.mU. A.fU.fC. A. A. A.fU. G.fU. G. A.mU*fC*mU* G* G* A* U. | 5% |
| 20622 | 449 | 3059 | G. A.mU.mC. A.mC. A.mU.mU.mU. G. A.mU. A.Chl-TEG | 3060 | P.mU. A. U. C. A. A. A. U. G. U. G. A.mU*mC*mU* G* G* A* U. | 25% |
| 20623 | 449 | 3061 | G. A.mU.mC. A.mC. A.mU.mU.mU. G. A.mU. A.Chl-TEG | 3062 | P.mU. A.fU.fC. A. A. A.fU. G.fU. G. A.mU*mC*mU*mG*mG*mA* U. | 14% |
| 20588 | 448 | 3063 | G. A.mU.mC. A.mC. A.mU.mU.mU. G. A. A.Chl-TEG | 3064 | P.mU.fU.fC. A. A. A.fU. G.fU. G. A.mU.mC*mU* G* G* A*mU* G. | 17% |
| 20589 | 448 | 3065 | G. A.mU.mC. A.mC. A.mU.mU.mU. G. A. A.Chl-TEG | 3066 | P.mU.fU.fC. A. A. A.fU. G.fU. G. A.mU.fC*mU* G* G* A*fU* G. | 40% |
| 20590 | 448 | 3067 | G. A.mU.mC. A.mC. A.mU.mU.mU. G. A. A.Chl-TEG | 3068 | P.mU. U. C. A. A. A. U. G. U. G. A.mU.mC*mU* G* G* A*mU* G. | 34% |
| 20591 | 448 | 3069 | G. A.mU.mC. A.mC. A.mU.mU.mU. G. A. A.Chl-TEG | 3070 | P.mU.fU.fC. A. A. A.fU. G.fU. G. A.fU.fC*fU*mG*mG*mA*fU* G. | n/a |

TABLE 20

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 13980 | 1222 | 3071 | A.mC. A. G. G. A. A. G. A.mU. G.mU. A.Chl | 3072 | P.mU. A.fC. A.fU.fC.fU.fU.fC.mU. G.mU* A* G*mU* A*mC* A. | 98% |
| 13981 | 813 | 3073 | G. A. G.mU. G. G. A. G.mC. G.mC.mC.mU.Chl | 3074 | P.mA. G. G.fC. G.fC.fU.fC.fC. A.mC.mU.mC*mU* G*mU* G* G* U. | 82% |
| 13982 | 747 | 3075 | mC. G. A.mC.mU. G. G. A. A. G. A.mC. A.Chl | 3076 | P.mU. G.fU.fC.fU.fU.fC.fC. A. G.mU.mC. G* G*mU* A* A* G* C. | 116% |
| 13983 | 817 | 3077 | G. G. A. G.mC. G.mC.mC.mU. G.mU.mU.mC.Chl | 3078 | P.mG. A. A.fC. A. G. G.fC. G.fC.mU.mC.mC* A*mC*mU*mC*mU* G. | 97% |
| 13984 | 1174 | 3079 | G.mC.mC. A.mU.mU. A.mC. A. A.mC.mU. G.Chl | 3080 | P.mC. A. G.fU.fU. G.fU. A. A.fU. G. G.mC* A* G* G*mC* A* C. | 102% |
| 13985

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 13994 | 797 | 3099 | mC.mC.mU. G. G.mU.mC.mC. A. G. A.mC.mC.Chl | 3100 | P.mG. G.fU.fC.fU. G. G. A.fC.fC. A. G. G*mC* A* G*mU*mU* G. | n/a |
| 13995 | 1175 | 3101 | mC.mC. A.mU.mU. A.mC. A. A.mC.mU. G.mU.Chl | 3102 | P.mA.fC. A. G.fU.fU. G.fU. A. A.mU. G. G*mC* A* G* G*mC* A. | 113% |
| 13996 | 1172 | 3103 | mC.mU. G.mC.mC. A.mU.mU. A.mC. A. A.mC.Chl | 3104 | P.mG.fU.fU. G.fU. A. A.fU. G. G.mC. A. G* G*mC* A*mC* A* G. | 110% |
| 13997 | 1177 | 3105 | A.mU.mU. A.mC. A. A.mC.mU. G.mU.mC.mC.Chl | 3106 | P.mG. G. A.fC. A. G.fU.fU. G.fU. A. A.mU* G* G*mC* A* G* G. | 105% |
| 13998 | 1176 | 3107 | mC. A.mU.mU. A.mC. A. A.mC.mU. G.mU.mC.Chl | 3108 | P.mG. A.fC. A. G.fU.fU. G.fU. A. A.mU. G* G*mC* A* G* G* C. | 89% |
| 13999 | 812 | 3109 | A. G. A. G.mU. G. G. A. G.mC. G.mC.mC.Chl | 3110 | P.mG. G.fC. G.fC.fU.fC. A.fC.mU.mC.mU* G*mU* G* G*mU* C. | 99% |
| 14000 | 745 | 3111 | A.mC.mC. G. A.mC.mU. G. G. A. A. G. A.Chl | 3112 | P.mU.fC.fU.fU.fC.fC. A. G.fU.fC. G. G.mU* A* A* G*mC*mC* G. | n/a |
| 14001 | 1230 | 3113 | A.mU. G.mU. A.mC. G. G. A. G. A.mC. A.Chl | 3114 | P.mU. G.fU.fC.fU.fC.fC. G.fU. A.mC. A.mU*mC*mU*mU* mC*mC* U. | 106% |
| 14002 | 920 | 3115 | G.mC.mC.mU.mU. G.mC. G. A. A. G.mC.mU.Chl | 3116 | P.mA. G.fC.fU.fU.fC. G.fC. A. A. G. G.mC*mC*mU* G* A*mC* C. | 93% |
| 14003 | 679 | 3117 | G.mC.mU. G.mC. G. A. G. G. A. G.mU. G.Chl | 3118 | P.mC. A.fC.fU.fC.fC.fU.fC. G.fC. A. G.mC* A*mU*mU*mU*mC* C. | 102% |
| 14004 | 992 | 3119 | G.mC.mC.mU. A.mU.mC. A. A. G.mU.mU.mU.Chl | 3120 | P.mA. A. A.fC.fU.fU. G. A.fU. A. G. G.mC*mU*mU* G* G* A* G. | 100% |
| 14005 | 1045 | 3121 | A. A.mU.mC.mU. A. G. A. G.mU. G. G. A. G.mU.Chl | 3122 | P.mA.fC.fU.fC.fC. A.fC. A. G. A. A.mU.mU*mU* A* G*mC*mU* C. | 104% |
| 14006 | 1231 | 3123 | mU. G.mU. A.mC. G. G. A. G. A.mC. A.mU.Chl | 3124 | P.mA.fU. G.fU.fC.fU.fC.fC. G.fU. A.mC. A*mU*mC*mU*mU* mC* C. | 87% |
| 14007 | 991 | 3125 | A. G.mC.mC.mU. A.mU.mC. A. A. G.mU.mU.Chl | 3126 | P.mA. A.fC.fU.fU. G. A.fU. A. G. G.mC.mU*mU* G* G* A* G* A. | 101% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14008 | 998 | 3127 | mC. A. A. G.mU.mU.mU. G. A. G.mC.mU.mU.Chl | 3128 | P.mA. A. G.fC. fU.fC. A. A. A.fC.mU.mU. G* A*mU* A* G* G* C. | 98% |
| 14009 | 1049 | 3129 | mC.mU. G.mU. G. G. A. G.mU. A.mU. G.mU.Chl | 3130 | P.mA.fC. A.fU. A.fC.fU.fC.fC. A.mC. A. G* A* A*mU*mU* A. | 98% |
| 14010 | 1044 | 3131 | A. A. A.mU.mU.mC.mU. G.mU. G. G. A. G.Chl | 3132 | P.mC.fU.fC.fC. A.fC. A. G. A. A.mU.mU.mU* A* G*mC*mU*mC* G. | 93% |
| 14011 | 1327 | 3133 | mU.mU.mU.mC. A. G.mU. A. G.mC. A.mC. A.Chl | 3134 | P.mU. G.fU. G.fC.fU. A.fC.fU. G. A. A. A*mU*mC* A*mU*mU* U. | 95% |
| 14012 | 1196 | 3135 | mC. A. A.mU. G. A.mC. A.mU.mC.mU.mU. mU.Chl | 3136 | P.mA. A. A. G. A.fU. G.fU.fC. A.mU.mU. G*mU*mC*mU*mC* mC* G. | 101% |
| 14013 | 562 | 3137 | A. G.mU. A.mC.mC. A. G.mU. G.mC. A.mC.Chl | 3138 | P.mG.fU. G.fC. A.fC.fU. G. G.fU. A.mC.mU*mU* G*mC* A* G* C. | 66% |
| 14014 | 752 | 3139 | G. G. A. A. G. A.mC. A.mC. G.mU.mU.mU.Chl | 3140 | P.mA. A. A.fC. G.fU. G.fU.fC.fU.mU.mC.mC * A* G*mU*mC* G. | 95% |
| 14015 | 994 | 3141 | mC.mU. A.mU.mC. A. A. G.mU.mU.mU. G. A.Chl | 3142 | P.mU.fC. A. A. A.fC.fU.fU. G. A.mU. A. G* G*mC*mU*mU* G* G. | 85% |
| 14016 | 1040 | 3143 | A. G.mC.mU. A. A. A.mU.mU.mC.mU. G.mU.Chl | 3144 | P.mA.fC. A. G. A. A.fU.fU.fU. A. G.mC.mU*mC* G*mU* A* U. | 61% |
| 14017 | 1984 | 3145 | A. G. G.mU. A. G. A. A.mU. G.mU. A. A.Chl | 3146 | P.mU.fU. A.fC. A.fU.fU.fC.fU. A.mC.mC.mU* A*mU* G* G*mU* G. | 32% |
| 14018 | 2195 | 3147 | A. G.mC.mU. G. A.mU.mC. A. G.mU.mU.mU.Chl | 3148 | P.mA. A. A.fC.fU. G. A.fU.fC. A. G.mC.mU* A*mU* A*mU* A* G. | 86% |
| 14019 | 2043 | 3149 | mU.mU.mC.mU. G.mC.mU.mC. A. G. A.mU. A.Chl | 3150 | P.mU. A.fU.fC.fU. G. A. G.fC. A. G. A. A*mU*mU*mU*mC* mC* A. | 81% |
| 14020 | 1892 | 3151 | mU.mU. A.mU.mC.mU. A. A. G.mU. A. A.Chl | 3152 | P.mU.fU. A. A.fC.fU.fU. A. G. A.mU. A. A*mC*mU* G*mU* A* C. | 84% |
| 14021 | 1567 | 3153 | mU. A.mU. A.mC. G. A. G.mU. A. A.mU. A.Chl | 3154 | P.mU. A.fU.fU. A.fC.fU.fC. G.fU. A.mU. A* A* G* A*mU* G* C. | 72% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14022 | 1780 | 3155 | G. A.mC.mU. G. G. A.mC. A. G.mC.mU.mU.Chl | 3156 | P.mA. A. G.fC.fU. G.fU.fC.fC. A. G.mU.mC*mU* A* A*mU*mC* G. | 65% |
| 14023 | 2162 | 3157 | A.mU. G. G.mC.mC.mU.mU. mU. A.mU.mU. A.Chl | 3158 | P.mU. A. A.fU. A. A. A. G. G.fC.mC. A.mU*mU* G*mU*mU* C. | 80% |
| 14024 | 1034 | 3159 | A.mU. A.mC.mC. G. A. G.mC.mU. A. A. A.Chl | 3160 | P.mU.fU.fU. A. G.fC.fU.fC. G. G.mU. A.mU* G*mU*mC*mU*mU* C. | 91% |
| 14025 | 2264 | 3161 | mU.mU. G.mU.mU. G. A. G. A. G.mU. G.mU.Chl | 3162 | P.mA.fC. A.fC.fU.fC.fU.fC. A. A.mC. A. A* A*mU* A* A* A* C. | 58% |
| 14026 | 1032 | 3163 | A.mC. A.mU. A.mC.mC. G. A. G.mC.mU. A.Chl | 3164 | P.mU. A. G.fC.fU.fC. G. G.fU. A.mU. G.mU*mC*mU*mU* mC* A* U. | 106% |
| 14027 | 1535 | 3165 | A. G.mC. A. G. A. A. A. G. G.mU.mU. A.Chl | 3166 | P.mU. A. A.fC.fC.fU.fU.fU.fC.fU. G.mC.mU* G* G*mU* A*mC* C. | 67% |
| 14028 | 1694 | 3167 | A. G.mU.mU. G.mU.mU.mC.mC. mU.mU. A. A.Chl | 3168 | P.mU.fU. A. A. G. G. A. A.fC. A. A.mC.mU*mU* G* A*mC*mU* C. | 94% |
| 14029 | 1588 | 3169 | A.mU.mU.mU. G. A. A. G.mU. G.mU. A. A.Chl | 3170 | P.mU.fU. A.fC. A.fC.fU.fU.fC. A. A. A.mU* A* G*mC* A* G* G. | 97% |
| 14030 | 928 | 3171 | A. A. G.mC.mU. G. A.mC.mC.mU. G. G. A.Chl | 3172 | P.mU.fC.fC. A. G. G.fU.fC. A. G.mC.mU.mU*mC* G*mC* A* A* G. | 100% |
| 14031 | 1133 | 3173 | G. G.mU.mC. A.mU. G. A. A. G. A. A. G.Chl | 3174 | P.mC.fU.fU.fC.fU.fU.fC. A.fU. G. A.mC.mC*mU*mC* G*mC*mC* G. | 82% |
| 14032 | 912 | 3175 | A.mU. G. G.mU.mC. A. G. G.mC.mC.mU.mU. Chl | 3176 | P.mA. A. G. G.fC.fC.fU. G. A.fC.mC. A.mU* G*mC* A*mC* A* G. | 84% |
| 14033 | 753 | 3177 | G. A. A. G. A.mC. A.mC. G.mU.mU.mU. G.Chl | 3178 | P.mC. A. A. A.fC. G.fU. G.fU.fC.mU.mU.mC*mC* A* G*mU*mC* G. | 86% |
| 14034 | 918 | 3179 | A. G. G.mC.mC.mU.mU. G.mC. G. A. A. G.Chl | 3180 | P.mC.fU.fU.fC. G.fC. A. A. G. G.mC.mC.mU* G* A*mC*mC* A* U. | 88% |
| 14035 | 744 | 3181 | mU. A.mC.mC. G. A.mC.mU. G. G. A. A. G.Chl | 3182 | P.mC.fU.fU.fC.fC. A. G.fU.fC. G. G.mU. A* A* G*mC*mC* G* C. | 95% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14036 | 466 | 3183 | A.mC.mC. G.mC. A. A. G. A.mU.mC. G. G.Chl | 3184 | P.mC.fC. G. A.fU.fC.fU.fU. G.fC. G. G.mU*mU* G* G*mC*mC* G. | 73% |
| 14037 | 917 | 3185 | mC. A. G. G.mC.mC.mU.mU. G.mC. G. A. A.Chl | 3186 | P.mU.fU.fC. G.fC. A. A. G. G.fC.mC.mU. G* A*mC*mC* A*mU* G. | 86% |
| 14038 | 1038 | 3187 | mC. G. A. G.mC.mU. A. A. A.mU.mU.mC.mU. Chl | 3188 | P.mA. G. A. A.fU.fU.fU. A. G.fC.mU.mC. G* G*mU* A*mU* G* U. | 84% |
| 14039 | 1048 | 3189 | mU.mC.mU. G.mU. G. G. A. G.mU. A.mU. G.Chl | 3190 | P.mC. A.fU. A.fC.fU.fC.fC. A.fC. A. G. A* A*mU*mU*mU* A* G. | 87% |
| 14040 | 1235 | 3191 | mC. G. G. A. G. A.mC. A.mU. G. G.mC. A.Chl | 3192 | P.mU. G.fC.fC. A.fU. G.fU.fC.fU.mC.mC. G*mU* A*mC* A*mU* C. | 100% |
| 14041 | 868 | 3193 | A.mU. G. A.mC. A. A.mC. G.mC.mC.mU.mC. Chl | 3194 | P.mG. A. G. G.fC. G.fU.fU. G.fU.mC. A.mU*mU* G* G*mU* A* A. | 104% |
| 14042 | 1131 | 3195 | G. A. G. G.mU.mC. A.mU. G. A. A. G. A.Chl | 3196 | P.mU.fC.fU.fU.fC. A.fU. G. A.fC.mC.mU.mC* G*mC*mC* G*mU* C. | 85% |
| 14043 | 1043 | 3197 | mU. A. A. A.mU.mU.mC.mU. G.mU. G. G. A.Chl | 3198 | P.mU.fC.fC. A.fC. A. G. A. A.fU.mU.mU. A* G*mC*mU*mC* G* G. | 74% |
| 14044 | 751 | 3199 | mU. G. G. A. A. G. A.mC. A.mC. G.mU.mU.Chl | 3200 | P.mA. A.fC. G.fU. G.fU.fC.fU.fU.mC.mC. A* G*mU*mC* G* G* U. | 84% |
| 14045 | 1227 | 3201 | A. A. G. A.mU. G.mU. A.mC. G. G. A. G.Chl | 3202 | P.mC.fU.fC.fC. G.fU. A.fC. A.fU.mC.mU.mU*mC* mC*mU* G*mU* A. | 99% |
| 14046 | 867 | 3203 | A. A.mU. G. A.mC. A. A.mC. G.mC.mC.mU.Chl | 3204 | P.mA. G. G.fC. G.fU.fU. G.fU.fC. A.mU.mU* G* G*mU* A* A* C. | 94% |
| 14047 | 1128 | 3205 | G. G.mC. G. A. G. G.mU.mC. A.mU. G. A.Chl | 3206 | P.mU.fC. A.fU. G. A.fC.fC.fU.fC. G.mC.mC* G*mU*mC* A* G* G. | 89% |
| 14048 | 756 | 3207 | G. A.mC. A.mC. G.mU.mU.mU. G. G.mC.mC.Chl | 3208 | P.mG. G.fC.fC. A. A. A.fC. G.fU. G.mU.mC*mU*mU*m C*mC* A* G. | 93% |
| 14049 | 1234 | 3209 | A.mC. G. G. A. G. A.mC. A.mU. G. G.mC.Chl | 3210 | P.mG.fC.fC. A.fU. G.fU.fC.fU.fC.mC. G.mU* A*mC* A*mU*mC* U. | 100% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14050 | 916 | 3211 | mU.mC. A. G. G.mC.mC.mU.mU. G.mC. G. A.Chl | 3212 | P.mU.fC. G.fC. A. A. G. G.fC.fC.mU. G. A*mC*mC* A*mU* G* C. | 96% |
| 14051 | 925 | 3213 | G.mC. G. A. A. G.mC.mU. G. A.mC.mC.mU.Chl | 3214 | P.mA. G. G.fU.fC. A. G.fC.fU.fU.mC. G.mC* A* A* G* G*mC* C. | 80% |
| 14052 | 1225 | 3215 | G. G. A. A. G. A.mU. G.mU. A.mC. G. G.Chl | 3216 | P.mC.fC. G.fU. A.fC. A.fU.fC.fU.mU.mC.mC *mU* G*mU* A* G* U. | 96% |
| 14053 | 445 | 3217 | G.mU. G. A.mC.mU.mU.mC. G. G.mC.mU.mC.Chl | 3218 | P.mG. A. G.fC.fC. G. A. A. G.fU.mC. A.mC* A* G* A* A* G* A. | 101% |
| 14054 | 446 | 3219 | mU. G. A.mC.mU.mU.mC. G. G.mC.mU.mC.mC. Chl | 3220 | P.mG. G. A. G.fC.fC. G. A. A. G.mU.mC. A*mC* A* G* A* A* G. | 93% |
| 14055 | 913 | 3221 | mU. G. G.mU.mC. A. G. G.mC.mC.mU.mU. G.Chl | 3222 | P.mC. A. A. G. G.fC.fC.fU. G. A.mC.mC. A*mU* G*mC* A*mC* A. | 67% |
| 14056 | 997 | 3223 | mU.mC. A. A. G.mU.mU.mU. G. A. G.mC.mU.Chl | 3224 | P.mA. G.fC.fU.fC. A. A. A.fC.fU.mU. G. A*mU* A* G* G*mC* U. | 92% |
| 14057 | 277 | 3225 | G.mC.mC. A. G. A. A.mC.mU. G.mC. A. G.Chl | 3226 | P.mC.fU. G.fC. A. G.fU.fU.fC.fU. G. G.mC*mC* G* A*mC* G* G. | 84% |
| 14058 | 1052 | 3227 | mU. G. G. A. G.mU. A.mU. G.mU. A.mC.mC.Chl | 3228 | P.mG. G.fU. A.fC. A.fU. A.fC.fU.mC.mC. A*mC* A* G* A* A* U. | n/a |
| 14059 | 887 | 3229 | G.mC.mU. A. G. A. G. A. A. G.mC. A. G.Chl | 3230 | P.mC.fU. G.fC.fU.fU.fC.fU.fC.fU. A. G.mC*mC*mU* G*mC* A* G. | 80% |
| 14060 | 914 | 3231 | G. G.mU.mC. A. G. G.mC.mC.mU.mU. G.mC.Chl | 3232 | P.mG.fC. A. A. G. G.fC.fC.fU. G. A.mC.mC* A*mU* G*mC* A* C. | 112% |
| 14061 | 1039 | 3233 | G. A. G.mC.mU. A. A. A.mU.mU.mC.mU. G.Chl | 3234 | P.mC. A. G. A. A.fU.fU.fU. A. G.mC.mU.mC* G*mU* A*mU* G. | 104% |
| 14062 | 754 | 3235 | A. A. G. A.mC. A.mC. A.mU.mU. G. G.Chl | 3236 | P.mC.fC. A. A. A.fC. G.fU. G.fU.mC.mU.mU*mC* mC* A* G*mU* C. | 109% |
| 14063 | 1130 | 3237 | mC. G. A. G. G.mU.mC. A.mU. G. A. A. G.Chl | 3238 | P.mC.fU.fU.fC. A.fU. G. A.fC.fC.mU.mC. G*mC*mC* G*mU*mC* A. | 103% |
| 14064 | 919 | 3239 | G. G.mC.mC.mU.mU. | 3240 | P.mG.fC.fU.fU.fC. G.fC. A. A. G. | 109% |

TABLE 20-continued

Inhibition of gene expression with CTGF sd-rxRNA sequences (Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| | | | G.mC. G. A. A. G.mC.Chl | | G.mC.mC*mU* G* A*mC*mC* A. | |
| 14065 | 922 | 3241 | mC.mU.mU. G.mC. G. A. A. G.mC.mU. G. A.Chl | 3242 | P.mU.fC. A. G.fC.fU.fU.fC. G.fC. A. A. G* G*mC*mC*mU* G* A. | 106% |
| 14066 | 746 | 3243 | mC.mC. G. A.mC.mU. G. G. A. A. G. A.mC.Chl | 3244 | P.mG.fU.fC.fU.fU.fC.fC. A. G.fU.mC. G. G*mU* A* A* G*mC* C. | 106% |
| 14067 | 993 | 3245 | mC.mC.mU. A.mU.mC. A. A. G.mU.mU.mU. G.Chl | 3246 | P.mC. A. A. A.fC.fU.fU. G. A.fU. A. G. G*mC*mU*mU* G* G* A. | 67% |
| 14068 | 825 | 3247 | mU. G.mU.mU.mC.mC. A. A. G. A.mC.mC.mU.Chl | 3248 | P.mA. G. G.fU.fC.fU.fU. G. G. A. A.mC. A* G* G*mC* G*mC* U. | 93% |
| 14069 | 926 | 3249 | mC. G. A. A. G.mC.mU. G. A.mC.mC.mU. G.Chl | 3250 | P.mC. A. G. G.fU.fC. A. G.fC.fU.mU.mC. G*mC* A* A* G* G* C. | 95% |
| 14070 | 923 | 3251 | mU.mU. G.mC. G. A. A. G.mC.mU. G. A.mC.Chl | 3252 | P.mG.fU.fC. A. G.fC.fU.fU.fC. G.mC. A. A* G* G*mC*mC*mU* G. | 95% |
| 14071 | 866 | 3253 | mC. A. A.mU. G. A.mC. A. A.mC. G.mC.mC.Chl | 3254 | P.mG. G.fC. G.fU.fU. G.fU.fC. A.mU.mU. G* G*mU* A* A*mC* C. | 132% |
| 14072 | 563 | 3255 | G.mU. A.mC.mC. A. G.mU. G.mC. A.mC. G.Chl | 3256 | P.mC. G.fU. G.fC. A.fC.fU. G. G.mU. A.mC*mU*mU* G*mC* A* G. | n/a |
| 14073 | 823 | 3257 | mC.mC.mU. G.mU.mU.mC.mC. A. A. G. A.mC.Chl | 3258 | P.mG.fU.fC.fU.fU. G. G. A. A.fC. A. G. G*mC* G*mC*mU*mC* C. | 98% |
| 14074 | 1233 | 3259 | mU. A.mC. G. G. A. G. A.mC. A.mU. G. G.Chl | 3260 | P.mC.fC. A.fU. G.fU.fC.fU.fC.fC. G.mU. A*mC* A*mU*mC*mU* U. | 109% |
| 14075 | 924 | 3261 | mU. G.mC. G. A. A. G.mC.mU. G. A.mC.mC.Chl | 3262 | P.mG. G.fU.fC. A. G.fC.fU.fU.fC. G.mC. A* A* G* G*mC*mC* U. | 95% |
| 14076 | 921 | 3263 | mC.mC.mU.mU. G.mC. G. A. A. G.mC.mU. G.Chl | 3264 | P.mC. A. G.fC.fU.fU.fC. G.fC. A. A. G. G*mC*mC*mU* G* A* C. | 116% |
| 14077 | 443 | 3265 | mC.mU. G.mU. G. A.mC.mU.mU.mC. G. G.mC.Chl | 3266 | P.mG.fC.fC. G. A. A. G.fU.fC. A.mC. A. G* A* A* G* A* G* G. | 110% |
| 14078 | 1041 | 3267 | G.mC.mU. A. A. A.mU.mU.mC.mU. G.mU. G.Chl | 3268 | P.mC. A.fC. A. G. A. A.fU.fU.fU. A. G.mC*mU*mC* G* G*mU* A. | 99% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 14079 | 1042 | 3269 | mC.mU. A. A. A.mU.mU.mC.mU. G.mU. G. G.Chl | 3270 | P.mC.fC. A.fC. A. G. A. A.fU.fU.mU. A. G*mC*mU*mC* G* G* U. | 109% |
| 14080 | 755 | 3271 | A. G. A.mC. A.mC. G.mU.mU.mU. G. G.mC.Chl | 3272 | P.mG.fC.fC. A. A. A.fC. G.fU. G.mU.mC.mU*mU*m C*mC* A* G* U. | 121% |
| 14081 | 467 | 3273 | mC.mC. G.mC. A. A. G. A.mU.mC. G. G.mC.Chl | 3274 | P.mG.fC. C.fG. A. U.fC.fU.fU.fG. C.mG. G*mU*mU* G* G*mC* C. | 132% |
| 14082 | 995 | 3275 | mU. A.mU.mC. A. A. G.mU.mU.mU. G. A. G.Chl | 3276 | P.mC.fU.fC. A. A. A.fC.fU.fU. G. A.mU. A* G* G*mC*mU*mU* G. | 105% |
| 14083 | 927 | 3277 | G. A. A. G.mC.mU. G. A.mC.mC.mU. G. G.Chl | 3278 | P.mC.fC. A. G. G.fU.fC. A. G.fC.mU.mU.mC* G*mC* A* A* G* G. | 114% |
| 17356 | 1267 | 3279 | A.mC. A.mU.mU. A. A.mC.mU.mC. A.mU. A.Chl | 3280 | P.mU. A.fU. G. A. G.mU.fU. A. A.fU. G.fU*fC*fU*fC*fU*fC * A. | 120% |
| 17357 | 1267 | 3281 | G. A.mC. A.mU.mU. A. A.mC.mU.mC. A.mU. A.Chl | 3282 | P.mU. A.fU. G. A. G.mU.fU. A. A.fU. G.fU*fC*fU*fC*fU*fC * A. | 56% |
| 17358 | 1442 | 3283 | mU. G. A. A. G. A. A.mU. G.mU.mU. A. A.Chl | 3284 | P.mU.fU. A. A.fC. A.fU.fU.fC.fU.fU.fC. A* A* A*fC*fC* A* G. | 34% |
| 17359 | 1442 | 3285 | mU.mU. G. A. A. G. A. A.mU. G.mU.mU. A. A.Chl | 3286 | P.mU.fU. A. A.fC. A.fU.fU.fC.fU.fU.fC. A* A* A*fC*fC* A* G. | 31% |
| 17360 | 1557 | 3287 | G. A.mU. A. G.mC. A.mU.mC.mU.mU. A. A.Chl | 3288 | P.mU.fU. A. A. G. A.fU. G.fC.fU. A.fU.fC*fU* G* A*fU* G* A. | 59% |
| 17361 | 1557 | 3289 | A. G. A.mU. A. G.mC. A.mU.mC.mU.mU. A. A.Chl | 3290 | P.mU.fU. A. A. G. A.fU. G.fC.fU. A.fU.fC*fU* G* A*fU* G* A. | 47% |
| 17362 | 1591 | 3291 | mU. G. A. A. G.mU. G.mU. A. A.mU.mU. A.Chl | 3292 | P.mU. A. A.fU.fU. A.fC. A.fC.fU.fU.fC. A* A* A*fU* A* G* C. | 120% |
| 17363 | 1599 | 3293 | A. A.mU.mU. G. A. G. A. A. G. G. A. A.Chl | 3294 | P.mU.fU.fC.fC.fU.fU.fC. fU.fC. A. A.fU.fU* A*fC* A*fC*fU* U. | 71% |
| 17364 | 1601 | 3295 | mU.mU. G. A. G. A. A. G. G. A. A. A. A.Chl | 3296 | P.mU.fU.fU.fU.fC.fC.fU. fU.fC.fU.fC. A. A*fU*fU* A*fC* A* C. | 62% |
| 17365 | 1732 | 3297 | mC. A.mU.mU.mC.mU. G. A.mU.mU.mC. G. A.Chl | 3298 | P.mU.fC. G. A. A.fU.fC. A. G. A. A.fU. G*fU*fC* A* G* A* G. | 99% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 17366 | 1734 | 3299 | mU.mU.mC.mU. G. A.mU.mU.mC. G. A. A. A.Chl | 3300 | P.mU.fU.fU.fC. G. A. A.fU.fC. A. G. A. A*fU* G*fU*fC* A* G. | 97% |
| 17367 | 1770 | 3301 | mC.mU. G.mU.mC. G. A.mU.mU. A. G. A. A.Chl | 3302 | P.mU.fU.fC.fU. A. A.fU.fC. G. A.fC. A. G* G* A*fU*fU*fC* C. | 45% |
| 17368 | 1805 | 3303 | mU.mU.mU. G.mC.mC.mU. G.mU. A. A.mC. A.Chl | 3304 | P.mU. G.fU.fU. A.fC. A. G. G.fC. A. A. A*fU*fU*fC* A*fC* U. | 71% |
| 17369 | 1805 | 3305 | A.mU.mU.mU. G.mC.mC.mU. G.mU. A. A.mC. A.Chl | 3306 | P.mU. G.fU.fU. A.fC. A. G. G.fC. A. A. A*fU*fU*fC* A*fC* U. | 67% |
| 17370 | 1815 | 3307 | A.mC. A. A. G.mC.mC. A. G. A.mU.mU. A.Chl | 3308 | P.mU. A. A.fU.fC.fU. G. G.fC.fU.fU. G.fU*fU* A*fC* A* G* G. | 65% |
| 17371 | 1815 | 3309 | A. A.mC. A. A. G.mC.mC. A. G. A.mU.mU. A.Chl | 3310 | P.mU. A. A.fU.fC.fU. G. G.fC.fU.fU. G.fU*fU* A*fC* A* G* G. | 35% |
| 17372 | 2256 | 3311 | mC. A. G.mU.mU.mU. A.mU.mU.mU. G.mU. A.Chl | 3312 | P.mU. A.fC. A. A. A.fU. A. A. A.fC.fU. G*fU*fC*fC* G* A* A. | 113% |
| 17373 | 2265 | 3313 | mU. G.mU.mU. G. A. G. A. G.mU. G.mU. A.Chl | 3314 | P.mU. A.fC. A.fC.fU.fC.fU.fC. A. A.fC. A* A* A*fU* A* A* A. | 35% |
| 17374 | 2265 | 3315 | mU.mU. G.mU.mU. G. A. G. A. G.mU. G.mU. A.Chl | 3316 | P.mU. A.fC. A.fC.fU.fC.fU.fC. A. A.fC. A* A* A*fU* A* A* A. | 31% |
| 17375 | 2295 | 3317 | mU. G.mC. A.mC.mC.mU.mU. mU.mC.mU. A. A.Chl | 1338 | P.mU.fU. A. G. A. A. A. G. G.fU. G.fC. A* A* A*fC* A*fU* G. | 34% |
| 17376 | 2295 | 3319 | mU.mU. G.mC. A.mC.mC.mU.mU. mU.mC.mU. A. A.Chl | 3320 | P.mU.fU. A. G. A. A. A. G. G.fU. G.fC. A* A* A*fC* A*fU* G. | 28% |
| 17377 | 1003 | 3321 | mU.mU. G. A. G.mC.mU.mU.mU. mC.mU. G. A.Chl | 3322 | P.mU.fC. A. G. A. A. A. G.fC.fU.fC. A. A* A*fC*fU* G* A. | 67% |
| 17378 | 2268 | 3323 | mU. G. A. G. A. G.mU. G.mU. G. A.mC. A.Chl | 3324 | P.mU. G.fU.fC. A.fC. A.fC.fU.fC.fU.fC. A* A*fC* A* A* U. | 42% |
| 17379 | 2272 | 3325 | A. G.mU. G.mU. G. A.mC.mC. A. A. A. A.Chl | 3326 | P.mU.fU.fU.fU. G. G.fU.fC. A.fC. A.fC.fU*fC*fU*fC* A* C. | 35% |
| 17380 | 2272 | 3327 | G. A. G.mU. G.mU. G. A.mC.mC. A. A. A. A.Chl | 3328 | P.mU.fU.fU.fU. G. G.fU.fC. A.fC. A.fC.fU*fC*fU*fC* A* C. | 29% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 17381 | 2273 | 3329 | G.mU. G.mU. G. A.mC.mC. A. A. A. A. A.Chl | 3330 | P.mU.fU.fU.fU.fU. G. G.fU.fC. A.fC. A.fC*fU*fC*fU*fC* A* A. | 42% |
| 17382 | 2274 | 3331 | mU. G.mU. G. A.mC.mC. A. A. A. A. G. A.Chl | 3332 | P.mU.fC.fU.fU.fU.fU. G. G.fU.fC. A.fC. A*fC*fU*fC*fU*fC* A. | 42% |
| 17383 | 2274 | 3333 | G.mU. G.mU. G. A.mC.mC. A. A. A. A. G. A.Chl | 3334 | P.mU.fC.fU.fU.fU.fU. G. G.fU.fC. A.fC. A*fC*fU*fC*fU*fC* A. | 37% |
| 17384 | 2275 | 3335 | G.mU. G. A.mC.mC. A. A. A. A. G.mU. A.Chl | 3336 | P.m U. A.fC.fU.fU.fU.fU. G. G.fU.fC. A.fC* A*fC*fU*fC*fU* C. | 24% |
| 17385 | 2277 | 3337 | G. A.mC.mC. A. A. A. A. G.mU.mU. A. A.Chl | 3338 | P.mU.fU. A. A.fC.fU.fU.fU.fU. G. G.fU.fC* A*fC* A*fC*fU* C. | 27% |
| 17386 | 2296 | 3339 | G.mC. A.mC.mC.mU.mU. mU.mC.mU. A. G. A.Chl | 3340 | P.mU.fC.fU. A. G. A. A. A. G. G.fU. G.fC* A* A* A*fC* A* U. | 23% |
| 17387 | 2299 | 3341 | mC.mC.mU.mU.mU.mC.mU. A. G.mU.mU. G. A.Chl | 3342 | P.mU.fC. A. A.fC.fU. A. G. A. A. A. G. G*fU* G*fC* A* A* A. | 46% |
| 21138 | 2296 | 3343 | G.mC. A.mC.mC.mU.mU. mU.mC.mU. A. G. A.TEG-Chl | 3344 | P.mU.fC.fU. A. G. A.mA. A. G. G.fU. G.mC* A* A* A*mC* A* U. | 42% |
| 21139 | 2296 | 3345 | G.mC. A.mC.mC.mU.mU. mU.mC.mU. A. G. A.TEG-Chl | 3346 | P.mU.fC.fU. A. G.mA. A.mA. G. G.fU. G.mC* A* A* A*mC* A* U. | 32% |
| 21140 | 2296 | 3347 | G.mC. A.mC.mC.mU.mU. mU.mC.mU. A. G. A.TEG-Chl | 3348 | P.mU.fC.fU. A. G. A. A. A. G. G.fU. G.mC* A*mA* A*mC* A* U. | 41% |
| 21141 | 2296 | 3349 | G.mC. A.mC.mC.mU.mU. mU.mC.mU. A. G. A.TEG-Chl | 3350 | P.mU.fC.fU. A. G. A.mA. A. G. G.fU. G.mC* A*mA* A*mC* A* U. | 51% |
| 21142 | 2296 | 3351 | G.mC. A.mC.mC.mU.mU. mU.mC.mU. A. G. A.TEG-Chl | 3352 | P.mU.fC.fU. A. G.mA. A.mA. G. G.fU. G.mC* A*mA* A*mC* A* U. | 25% |
| 21143 | 2296 | 3353 | G.mC. A.mC.mC.mU.mU. mU.mC.mU. A. G. A.TEG-Chl | 3354 | P.mU.fC.fU. A. G. A. A. A. G. G.fU. G.fC*mA*mA*mA*fC* mA* U. | 61% |
| 21144 | 2296 | 3355 | G.mC. A.mC.mC.mU.mU. mU.mC.mU. A. G. A.TEG-Chl | 3356 | P.mU.fC.fU. A. G. A.mA. A. G. G.fU. G.fC*mA*mA*mA*fC* mA* U. | 49% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 21145 | 2296 | 3357 | G.mC. A.mC.mC.mU.mU. mU.mC.mU. A. G. A.TEG-Chl | 3358 | P.mU.fC.fU. A. G.mA. A.mA. G. G.fU. G.fC*mA*mA*mA*fC* mA* U. | 46% |
| 21146 | 2296 | 3359 | G.mC. A.mC.mC.mU.mU. mU.mC.mU. A*mG*mA.TEG-Chl | 3360 | P.mU.fC.fU. A. G. A. A. A. G. G.fU. G.fC* A* A* A*fC* A* U. | 37% |
| 21147 | 2296 | 3361 | mG*mC* A.mC.mC.mU.mU. mU.mC.mU. A*mG*mA.TEG-Chl | 3362 | P.mU.fC.fU. A. G. A. A. A. G. G.fU. G.fC* A* A* A*fC* A* U. | 43% |
| 21148 | 2296 | 3363 | mG*mC*mA.mC. mC.mU.mU.mU.mC.mU.mA*mG*mA.TEG-Chl | 3364 | P.mU.fC.fU. A. G. A. A. A. G. G.fU. G.fC* A* A* A*fC* A* U. | 29% |
| 21149 | 2275 | 3365 | G.mU. G. A.mC.mC. A. A. A. A. G*mU*mA.TEG-Chl | 3366 | P.mU. A.fC.fU.fU.fU.fU. G. G.fU.fC. A.fC* A*fC*fU*fC*fU* C. | 138% |
| 21150 | 2275 | 3367 | mG*mU* G. A.mC.mC. A. A.mA. A. G*mU*mA.TEG-Chl | 3368 | P.mU. A.fC.fU.fU.fU.fU. G. G.fU.fC. A.fC* A*fC*fU*fC*fU* C. | 116% |
| 21151 | 2275 | 3369 | mG*mU*mG.mA. mC.mC.mA.mA.m A.mG*mU*mA.TEG-Chl | 3370 | P.mU. A.fC.fU.fU.fU.fU. G. G.fU.fC. A.fC* A*fC*fU*fC*fU* C. | 105% |
| 21152 | 2295 | 3371 | mU.mU. G.mC. A.mC.mC.mU.mU. mU.mC.mU. A. A.TEG-Chl | 3372 | P.mU.fU. A. G. A.mA. A. G. G.fU. G.fC. A. A* A*fC* A*fA* G* G. | 46% |
| 21153 | 2295 | 3373 | mU.mU. G.mC. A.mC.mC.mU.mU. mU.mC.mU. A. A.TEG-Chl | 3374 | P.mU.fU. A. G.mA. A.mA. G. G.fU. G.fC. A. A* A*fC* A*fA* G* G. | 28% |
| 21154 | 2295 | 3375 | mU.mU. G.mC. A.mC.mC.mU.mU. mU.mC.mU. A. A.TEG-Chl | 3376 | P.mU.fU.mA. G.mA. A.mA. G.mG.fU. G.fC. A. A* A*fC* A*fA* G* G. | 28% |
| 21155 | 2295 | 3377 | mU.mU. G.mC. A.mC.mC.mU.mU. mU.mC.mU. A. A.TEG-Chl | 3378 | P.mU.fU. A. G. A.mA. A. G. G.fU. G.mC. A. A* A*mC* A*mA* G* G. | 60% |
| 21156 | 2295 | 3379 | mU.mU. G.mC. A.mC.mC.mU.mU. mU.mC.mU. A. A.TEG-Chl | 3380 | P.mU.fU. A. G. A.mA. A. G. G.fU. G.fC. A.mA*mA*fC*mA*fA* mG* G. | 54% |
| 21157 | 2295 | 3381 | mU.mU. G.mC. A.mC.mC.mU.mU. mU.mC.mU. A. A.TEG-Chl | 3382 | P.mU.fU. A. G. A.mA. A. G. G.fU. G.fC.mA.mA*mA*fC* mA*fA*mG* G. | 40% |
| 21158 | 2295 | 3383 | mU.mU. G.mC. A.mC.mC.mU.mU. | 3384 | P.mU.fU. A. G. A.mA. A. G. G.fU. G.fC. | n/a |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| | | | mU.mC.mU. A. A.TEG-Chl | | A.mA*mA*fC*mA*mA *mG* G. | |
| 21159 | 2295 | 3385 | mU.mU. G.mC. A.mC.mC.mU.mU. mU.mC.mU. A. A.TEG-Chl | 3386 | P.mU.fU. A. G. A.mA. A. G. G.fU. G.fC. A.mA*mA*mC*mA*m A*mG* G. | 41% |
| 21160 | 2295 | 3387 | mU.mU. G.mC. A.mC.mC.mU.mU. mU.mC.mU. A. A.Chl-TEG | 3388 | P.mU.fU. A. G. A.mA. A. G. G.fU. G.fC.mA. A*mA*mC*mA*mA* mG*mG. | 65% |
| 21161 | 2295 | 3389 | mU.mU. G.mC. A.mC.mC.mU.mU. mU.mC.mU. A. A.TEG-Chl | 3390 | P.mU.fU. A. G. A.mA. A. G. G.fU. G.fC. A. A* A*fC* A*mA*mG* G. | 43% |
| 21162 | 2295 | 3391 | mU.mU. G.mC. A.mC.mC.mU.mU. mU.mC.mU. A. A.TEG-Chl | 3392 | P.mU.fU. A. G. A.mA. A. G. G.fU. G.fC.mA. A*mA*fC* A*mA*mG* G. | 41% |
| 21163 | 2295 | 3393 | mU.mU. G.mC. A.mC.mC.mU.mU. mU.mC.mU. A* A*TEG-Chl | 3394 | P.mU.fU. A. G. A. A. A. G. G.fU. G.fC. A. A* A*fC* A* A* G* G. | 32% |
| 21164 | 2295 | 3395 | mU.mU. G.mC. A.mC.mC.mU.mU. mU.mC.mU.mA* mA*TEG-Chl | 3396 | P.mU.fU. A. G. A. A. A. G. G.fU. G.fC. A. A* A*fC* A* A* G* G. | 39% |
| 21165 | 2295 | 3397 | mU*mU* G.mC. A.mC.mC.mU.mU. mU.mC.mU.mA* mA*TEG-Chl | 3398 | P.mU.fU. A. G. A. A. A. G. G.fU. G.fC. A. A* A*fC* A* A* G* G. | 28% |
| 21166 | 2295 | 3399 | mU.mU.mG.mC.m A.mC.mC.mU.mU. mU.mC.mU.mA* mA*TEG-Chl | 3400 | P.mU.fU. A. G. A. A. A. G. G.fU. G.fC. A. A* A*fC* A* A* G* G. | 27% |
| 21167 | 2299 | 3401 | mC.mC.mU.mU.m U.mC.mU. A. G.mU.mU. G. A.TEG-Chl | 3402 | P.mU.fC. A. A.fC.fU. A. G. A.mA. A. G. G*fU* G*fC* A* A* A. | 49% |
| 21168 | 2299 | 3403 | mC.mC.mU.mU.m U.mC.mU. A. G.mU.mU. G. A.TEG-Chl | 3404 | P.mU.fC. A. A.fC.fU. A. G. A.mA. A. G. G*mU* G*mC* A* A* A. | 53% |
| 21169 | 2299 | 3405 | mC.mC.mU.mU.m U.mC.mU. A. G.mU.mU. G. A.TEG-Chl | 3406 | P.mU.fC. A. A.fC.fU. A. G.mA. A. A.mG. G*fU* G*fC* A* A* A. | 47% |
| 21170 | 2299 | 3407 | mC.mC.mU.mU.m U.mC.mU. A. G.mU.mU. G. A.TEG-Chl | 3408 | P.mU.fC. A. A.fC.fU. A. G.mA. A. A.mG. G*mU* G*mC* A* A* A. | 70% |
| 21171 | 2299 | 3409 | mC.mC.mU.mU.m U.mC.mU. A. G.mU.mU. G. A.TEG-Chl | 3410 | P.mU.fC. A. A.fC.fU. A. G. A.mA. A. G. G*mU* G*mC* A*mA* A. | 65% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 21172 | 2299 | 3411 | mC.mC.mU.mU.mU.mC.mU. A. G.mU.mU. G. A.TEG-Chl | 3412 | P.mU.fC. A. A.fC.fU. A. G. A.mA. A. G. G*mU* G*mC*mA*mA* A. | 43% |
| 21173 | 2299 | 3413 | mC.mC.mU.mU.mU.mC.mU. A. G.mU.mU. G. A.TEG-Chl | 3414 | P.mU.fC. A. A.fC.fU. A. G. A.mA. A. G.mG*mU*mG*mC* mA*mA* A. | 52% |
| 21174 | 2299 | 3415 | mC.mC.mU.mU.mU.mC.mU. A. G.mU.mU. G. A.TEG-Chl | 3416 | P.mU.fC. A. A.fC.fU. A. G. A.mA. A. G. G*mU*mG*mC*mA* mA* A. | 47% |
| 21175 | 2299 | 3417 | mC.mC.mU.mU.mU.mC.mU. A. G.mU.mU. G. A.TEG-Chl | 3418 | P.mU.fC. A. A.fC.fU. A. G. A.mA. A. G. G*fU*mG*fC*mA*mA * A. | 35% |
| 21176 | 2299 | 3419 | mC.mC.mU.mU.mU.mC.mU. A. G.mU.mU. G. A.TEG-Chl | 3420 | P.mU.fC. A. A.fC.fU. A. G.mA. A. A.mG. G*fU*mG*fC*mA*mA * A. | 50% |
| 21177 | 2299 | 3421 | mC.mC.mU.mU.mU.mC.mU. A. G.mU.mU*mG*m A.TEG-Chl | 3422 | P.mU.fC. A. A.fC.fU. A. G. A. A. A. G. G*fU* G*fC* A* A* A. | 37% |
| 21178 | 2299 | 3423 | mC*mC*mU.mU. mU.mC.mU. A. G.mU.mU*mG*m A.TEG-Chl | 3424 | P.mU.fC. A. A.fC.fU. A. G. A. A. A. G. G*fU* G*fC* A* A* A. | 36% |
| 21179 | 2299 | 3425 | C*mC*mU.mU. mU.mC.mU.mA.m G.mU.mU*mG*m A.TEG-Chl | 3426 | P.mU.fC. A. A.fC.fU. A. G. A. A. A. G. G*fU* G*fC* A* A* A. | 35% |
| 21203 | 2296 | 3427 | G.mC. A.mC.mC.mU.mU. mU.mC.mU. A*mG*mA.TEG-Chl | 3428 | P.mU.fC.fU. A. G. A.mA. A. G. G.fU. G.mC* A* A* A*mC* A* U. | 40% |
| 21204 | 2296 | 3429 | G.mC. A.mC.mC.mU.mU. mU.mC.mU. A*mG*mA.TEG-Chl | 3430 | P.mU.fC.fU. A. G.mA. A.mA. G. G.fU. G.mC* A* A* A*mC* A* U. | 28% |
| 21205 | 2296 | 3431 | G.mC. A.mC.mC.mU.mU. mU.mC.mU. A*mG*mA.TEG-Chl | 3432 | P.mU.fC.fU. A. G.mA. A.mA. G. G.fU. G.mC* A*mA* A*mC* A* U. | 51% |
| 21206 | 2296 | 3433 | mG*mC* A.mC.mC.mU.mU. mU.mC.mU. A*mG*mA.TEG-Chl | 3434 | P.mU.fC.fU. A. G. A.mA. A. G. G.fU. G.mC* A* A* A*mC* A* U. | 46% |
| 21207 | 2296 | 3435 | mG*mC* A.mC.mC.mU.mU. mU.mC.mU. A*mG*mA.TEG-Chl | 3436 | P.mU.fC.fU. A. G.mA. A.mA. G. G.fU. G.mC* A* A* A*mC* A* U. | 29% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 21208 | 2296 | 3437 | mG*mC* A.mC.mC.mU.mU. mU.mC.mU. A*mG*mA.TEG-Chl | 3438 | P.mU.fC.fU. A. G.mA. A.mA. G. G.fU. G.mC* A*mA* A*mC* A* U. | 72% |
| 21209 | 2296 | 3439 | mG*mC*mA.mC. mC.mU.mU.mU.m C.mU.mA*mG*m A.TEG-Chl | 3440 | P.mU.fC.fU. A. G. A.mA. A. G. G.fU. G.mC* A* A* A*mC* A* U. | 89% |
| 21210 | 2296 | 3441 | mG*mC*mA.mC. mC.mU.mU.mU.m C.mU.mA*mG*m A.TEG-Chl | 3442 | P.mU.fC.fU. A. G.mA. A.mA. G. G.fU. G.mC* A* A* A*mC* A* U. | 65% |
| 21211 | 2296 | 3443 | mG*mC*mA.mC. mC.mU.mU.mU.m C.mU.mA*mG*m A.TEG-Chl | 3444 | P.mU.fC.fU. A. G.mA. A.mA. G. G.fU. G.mC* A*mA* A*mC* A* U. | 90% |
| 21212 | 2295 | 3445 | mU.mU. G.mC. A.mC.mC.mU.mU. mU.mC.mU*mA* mA.TEG-Chl | 3446 | P.mU.fU. A. G. A.mA. A. G. G.fU. G.fC.mA.mA*mA*fC* mA*mA*mG* G. | 60% |
| 21213 | 2295 | 3447 | mU.mU. G.mC. A.mC.mC.mU.mU. mU.mC.mU*mA* mA.TEG-Chl | 3448 | P.mU.fU. A. G. A.mA. A. G. G.fU. G.fC. A.mA*mA*mC*mA*m A*mG* G. | 63% |
| 21214 | 2295 | 3449 | mU.mU. G.mC. A.mC.mC.mU.mU. mU.mC.mU*mA* mA.TEG-Chl | 3450 | P.mU.fU. A. G. A.mA. A. G. G.fU. G.fC. A. A* A*fC* A*mA*mG* G. | 52% |
| 21215 | 2295 | 3451 | mU.mU. G.mC. A.mC.mC.mU.mU. mU.mC.mU*mA* mA.TEG-Chl | 3452 | P.mU.fU. A. G. A.mA. A. G. G.fU. G.fC.mA. A*mA*fC* A*mA*mG* G. | 45% |
| 21216 | 2295 | 3453 | mU*mU* G.mC. A.mC.mC.mU.mU. mU.mC.mU*mA* mA.TEG-Chl | 3454 | P.mU.fU. A. G. A.mA. A. G. G.fU. G.fC.mA.mA*mA*fC* mA*mA*mG* G. | 65% |
| 21217 | 2295 | 3455 | mU*mU* G.mC. A.mC.mC.mU.mU. mU.mC.mU*mA* mA.TEG-Chl | 3456 | P.mU.fU. A. G. A.mA. A. G. G.fU. G.fC. A.mA*mA*mC*mA*m A*mG* G. | 69% |
| 21218 | 2295 | 3457 | mU*mU* G.mC. A.mC.mC.mU.mU. mU.mC.mU*mA* mA.TEG-Chl | 3458 | P.mU.fU. A. G. A.mA. A. G. G.fU. G.fC. A. A* A*fC* A*mA*mG* G. | 62% |
| 21219 | 2295 | 3459 | mU*mU* G.mC. A.mC.mC.mU.mU. mU.mC.mU*mA* mA.TEG-Chl | 3460 | P.mU.fU. A. G. A.mA. A. G. G.fU. G.fC.mA. A*mA*fC* A*mA*mG* G. | 54% |
| 21220 | 2295 | 3461 | mU.mU.mG.mC.m A.mC.mC.mU.mU. mU.mC.mU*mA* mA.TEG-Chl | 3462 | P.mU.fU. A. G. A.mA. A. G. G.fU. G.fC.mA.mA*mA*fC* mA*mA*mG* G. | 52% |
| 21221 | 2295 | 3463 | mU.mU.mG.mC.m A.mC.mC.mU.mU. mU.mC.mU*mA* mA.TEG-Chl | 3464 | P.mU.fU. A. G. A.mA. A. G. G.fU. G.fC. A.mA*mA*mC*mA*m A*mG* G. | 53% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 21222 | 2295 | 3465 | mU.mU.mG.mC.mA.mC.mC.mU.mU.mU.mC.mU*mA*mA.TEG-Chl | 3466 | P.mU.fU. A. G. A.mA. A. G. G.fU. G.fC. A. A*A*fC* A*mA*mG* G. | 43% |
| 21223 | 2295 | 3467 | mU.mU.mG.mC.mA.mC.mC.mU.mU.mU.mC.mU*mA*mA.TEG-Chl | 3468 | P.mU.fU. A. G. A.mA. A. G. G.fU. G.fC.mA. A*mA*fC* A*mA*mG* G. | 43% |
| 21224 | 2299 | 3469 | mC.mC.mU.mU.mU.mC.mU. A. G.mU.mU*mG*mA.TEG-Chl | 3470 | P.mU.fC. A. A.fC.fU. A. G. A.mA. A. G. G*fU*mG*fC*mA*mA * A. | 60% |
| 21225 | 2299 | 3471 | mC*mC*mU.mU.mU.mC.mU. A. G.mU.mU*mG*mA.TEG-Chl | 3472 | P.mU.fC. A. A.fC.fU. A. G. A.mA. A. G. G*fU*mG*fC*mA*mA * A. | 67% |
| 21226 | 2299 | 3473 | mC*mC*mU.mU.mU.mC.mU.mA.mG.mU.mU*mG*mA.TEG-Chl | 3474 | P.mU.fC. A. A.fC.fU. A. G. A.mA. A. G. G*fU*mG*fC*mA*mA * A. | 66% |
| 21227 | 2296 | 3475 | G.mC. A.mC.mC.mU.mU.mU.mC.mU. A*mG*mA.TEG-Chl | 3476 | P.mU.fC.fU. A. G.mA. A.mA. G. G.fU. G.fC*mA*mA*mA*fC* mA* U. | 49% |
| 20584 | 2296 | 3477 | G.mC. A.mC.mC.mU.mU.mU.mC.mU. A. G. A.Chl-TEG | 3478 | P.mU.fC.fU. A. G. A. A. A. G. G.mU. G.mC* A* A* A*mC* A* U. | 70% |
| 20585 | 2296 | 3479 | G.mC. A.mC.mC.mU.mU.mU.mC.mU. A. G. A.Chl-TEG | 3480 | P.mU.fC.fU. A. G. A. A. A. G. G.fU. G.mC* A* A* A*mC* A* U. | 15% |
| 20586 | 2296 | 3481 | G.mC. A.mC.mC.mU.mU.mU.mC.mU. A. G. A.Chl-TEG | 3482 | P.mU. C. U. A. G. A. A. A. G. G.mU. G.mC* A* A* A*mC* A* U. | 30% |
| 20587 | 2296 | 3483 | G.mC. A.mC.mC.mU.mU.mU.mC.mU. A. G. A.Chl-TEG | 3484 | P.mU.fC.fU. A. G. A. A. A. G. G.fU. G.fC*mA*mA*mA*fC* mA* U. | 32% |
| 20616 | 2275 | 3485 | G.mU. G. A.mC.mC. A. A. A. A. G.mU. A.Chl-TEG | 3486 | P.mU. A.fC.fU.fU.fU.fU. G. G.fU.mC. A.mC* A*mC*mU*mC*mU* C. | 22% |
| 20617 | 2275 | 3487 | G.mU. G. A.mC.mC. A. A. A. A. G.mU. A.Chl-TEG | 3488 | P.mU. A.fC.fU.fU.fU.fU. G. G.fU.fC. A.mC* A*fC*mU*fC*mU* C. | 18% |
| 20618 | 2275 | 3489 | G.mU. G. A.mC.mC. A. A. A. A. G.mU. A.Chl-TEG | 3490 | P.mU. A. C. U. U. U. U. G. G. U.mC. A.mC* A*mC*mU*mC*mU* C. | 36% |

TABLE 20-continued

Inhibition of gene expression with CTGF sd-rxRNA sequences
(Accession Number: NM_001901.2)

| Oligo Number | Start Site | SEQ ID NO | Sense sequence | SEQ ID NO | Antisense sequence | % remaining mRNA expression (1 uM sd-rxRNA, A549) |
|---|---|---|---|---|---|---|
| 20619 | 2275 | 3491 | G.mU. G. A.mC.mC. A. A. A. A. G.mU. A.Chl-TEG | 3492 | P.mU. A.fC.fU.fU.fU. G. G.fU.fC. A.mC*mA*mC*mU*mC*mU* C. | 28% |
| 21381 | 2275 | 3493 | G.mU. G. A.mC.mC. A. A. A. A. G*mU*mA.TEG-Chl | 3494 | P.mU. A.fC.fU.fU.fU.fU. G. G.fU.mC. A.mC* A*mC*mU*mC*mU* C. | 28% |
| 21382 | 2275 | 3495 | G.mU. G. A.mC.mC. A. A. A. A. G*mU*mA.TEG-Chl | 3496 | P.mU. A.fC.fU.fU.fU.fU. G. G.fU.fC. A.mC* A*fC*mU*fC*mU* C. | 28% |
| 21383 | 2275 | 3497 | mG*mU*mG.mA. mC.mC.mA.mA.m A.mA.mG*mU*m A.TEG-Chl | 3498 | P.mU. A.fC.fU.fU.fU.fU. G. G.fU.mC. A.mC* A*mC*mU*mC*mU* C. | 43% |
| 21384 | 2275 | 3499 | mG*mU*mG.mA. mC.mC.mA.mA.m A.mA.mG*mU*m A.TEG-Chl | 3500 | P.mU. A.fC.fU.fU.fU.fU. G. G.fU.fC. A.mC* A*fC*mU*fC*mU* C. | 50% |
| 20392 | 2275 | 3501 | G.mU. G. A.mC.mC. A. A. A. A. G.mU. A.TEG-Chl | 3502 | P.mU. A.fC.fU.fU.fU.fU. G. G.fU.fC. A.fC* A*fC*fU*fC*fU* C. | 28% |
| 20393 | 2296 | 3503 | G.mC. A.mC.mC.mU.mU. mU.mC.mU. A. G. A.TEG-Chl | 3504 | P.mU.fC.fU. A. G. A. A. A. G. G.fU. G.fC* A* A* A*fC* A* U. | 35% |
| 21429 | 2275 | 3505 | G.mU. G. A.mC.mC. A. A. A. A. G*mU*mA.Teg-Chl | 3506 | P.mU. A.fC.fU.fU.fU.fU. G. G.fU.fC. A.mC* A*fC*mU*fC*mU* C. | 36% |
| 21430 | 2275 | 3507 | G.mU. G. A.mC.mC. A. A.mA. A. G*mU*mA.Teg-Chl | 3508 | P.mU. A.fC.fU.fU.fU.fU. G. G.fU.mC. A.mC* A*mC*mU*mC*mU* C. | 31% |

TABLE 21

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 14408 | 1324 | 3509 | G. G.mC.mU.mC.mU. mC.mC.mU.mU.mC. G. A.Chl | 3510 | P.mU.fC. G. A. A. G. G. A. G. A. G.mC.mC* A*mU*mC* G* C. | 94% |

TABLE 21-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 14409 | 1374 | 3511 | G. A.mC. A. G. G. A. A.mC.mC.mU. G. G.Chl | 3512 | P.mC.fC. A. G. G.fU.fU.fC.fC.fU. G.mU.mC*mU*mU*mU* A*mU* G. | n/a |
| 14410 | 946 | 3513 | mC.mC. A. A. G. G. A. G. G.mU.mU.mU. A.Chl | 3514 | P.mU. A. A. A.fC.fC.fU.fC.fC.fU.mU. G. G*mC* G*mU* A* G* U. | 90% |
| 14411 | 849 | 3515 | A.mU.mU.mU.mC. mC. A.mU.mC.mU. A.mC. A.Chl | 3516 | P.mU. G.fU. A. G. A.fU. G. G. A. A. A.mU*mC* A*mC*mC*mU* C. | 72% |
| 14412 | 852 | 3517 | mU.mC.mC. A.mU.mC.mU. A.mC. A. A.mC. A.Chl | 3518 | P.mU. G.fU.fU. G.fU. A. G. A.fU. G. G. A* A* A*mU*mC* A* C. | 76% |
| 14413 | 850 | 3519 | mU.mU.mU.mC.mC. A.mU.mC.mU. A.mC. A. A.Chl | 3520 | P.mU.fU. G.fU. A. G. A.fU. G. G. A. A. A*mU*mC* A*mC*mC* U. | 98% |
| 14414 | 944 | 3521 | mC. G.mC.mC. A. A. G. G. A. G. G.mU.mU.Chl | 3522 | P.mA. A.fC.fC.fU.fC.fC.fU.fU. G. G.mC. G*mU* A* G*mU* A* C. | 100% |
| 14415 | 1513 | 3523 | G.mU. G. G.mU. G. A.mU.mC. A. G. A. A.Chl | 3524 | P.mU.fU.fC.fU. G. A.fU.fC. A.fC. A.mC. A.mC*mU* G* G*mU* A* U. | n/a |
| 14416 | 1572 | 3525 | mC.mU.mC.mC.mU. G.mC.mU. A. A.mU. G.mU.Chl | 3526 | P.mA.fC. A.fU.fU. A. G.fC. A. G. A. G* A*mU* G*mU* G* G. | 100% |
| 14417 | 1497 | 3527 | A.mC.mC.mU.mC.mC. A.mC. A.mU. A.mU. A.Chl | 3528 | P.mU. A.fU. A.fU. G.fU. G. G. A. G. G.mU* G*mC*mC* A*mU* C. | 73% |
| 14418 | 1533 | 3529 | A. A. G.mU.mC.mC. A.mC.mU. A. G. G. A.Chl | 3530 | P.mU.fC.fC.fU. A. G.fU. G. G. A.mC.mU.mU*mU* A*mU* A* G* U. | 98% |
| 14419 | 1514 | 3531 | mU. G. G.mU. G. A.mU.mC. A. G. A. A. A.Chl | 3532 | P.mU.fU.fU.fC.fU. G. A.fU.fC. A.mC. A.mC.mC*mU* G* G*mU* A. | 86% |
| 14420 | 1534 | 3533 | A. G.mU.mC.mC. A.mC.mC. A. G. G. A. A.Chl | 3534 | P.mU.fU.fC.fC.fU. A. G.fU. G. G. A.mC.mU*mU*mU* A*mU* A* G. | 99% |
| 14421 | 943 | 3535 | A.mC. G.mC.mC. A. G. G. A. G. G.mU.Chl | 3536 | P.mA.fC.fC.fU.fC.fC.fU. fU. G. G.mC. G.mU* A* G*mU* A*mC* U. | 41% |
| 18570 | 2445 | 3537 | mU. A.mU.mU.mU. A.mU.mU. G.mU. G.mU. A.Chl | 3538 | P.mU. A.fC. A.fC. A. A.fU. A. A. A.fU. A* A*fC*fU*fC* A* C. | 79% |
| 18571 | 2445 | 3539 | mU.mU. A.mU.mU.mU. A.mU.mU. G.mU. G.mU. A.Chl | 3540 | P.mU. A.fC. A.fC. A. A.fU. A. A. A.fU. A* A*fC*fU*fC* A* C. | 75% |

TABLE 21-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 18572 | 2083 | 3541 | A.mU. C. A. G.mU. G.mU.mU. A. A. A. A.Chl | 3542 | P.mU.fU.fU.fU. A. A.fC. A.fC.fU. G. A.fU* G* A* A*fC*fC* A. | 47% |
| 18573 | 2083 | 3543 | mC. A.mU.mC. A. G.mU. G.mU.mU. A. A. A. A.Chl | 3544 | P.mU.fU.fU.fU. A. A.fC. A.fC.fU. G. A.fU* G* A* A*fC*fC* A. | 17% |
| 18574 | 2544 | 3545 | A.mU. G. G.mC.mU.mU. A. A. G. G. A. A.Chl | 3546 | P.mU.fU.fC.fC.fU.fU. A. A. G.fC.fC. A. U*fC*fC* A*fU* G* A. | 59% |
| 18575 | 2544 | 3547 | G. A.mU. G. G.mC.mU.mU. A. A. G. G. A. A.Chl | 3548 | P.mU.fU.fC.fC.fU.fU. A. A. G.fC.fC. A. U*fC*fC* A*fU* G* A. | 141% |
| 18576 | 2137 | 3549 | mU.mU. G.mU. G.mU.mU.mC.mU. G.mU. A.Chl | 3550 | P.mU. A. A.fC. A. G. A. A.fC. A.fC. A. A* A*fC*fU*fU*fC* C. | 77% |
| 18577 | 2137 | 3551 | mU.mU.mU. G.mU. G.mU.mU.mC.mU. G.mU. A.Chl | 3552 | P.mU. A. A.fC. A. G. A. A.fC. A.fC. A. A* A*fC*fU*fU*fC* C. | 59% |
| 18578 | 2520 | 3553 | A. A. A.mU. A.mC.mU.mU. G.mC.mC. A.Chl | 3554 | P.mU. G. G.fC. A. A. A. G.fU. A.fU.fU.fU* G* G*fU*fC*fU* C. | 75% |
| 18579 | 2520 | 3555 | mC. A. A. A.mU. A.mC.mU.mU. G.mC.mC. A.Chl | 3556 | P.mU. G. G.fC. A. A. A. G.fU. A.fU.fU.fU* G* G*fU*fC*fU* C. | 55% |
| 18580 | 3183 | 3557 | mC.mU.mU. G.mC. A.mC.mU. A.mC. A. A. A.Chl | 3558 | P.mU.fU.fU. G.fU. A. G.fU. G.fC. A. A. G*fU*fC* A* A* A* C. | 84% |
| 18581 | 3183 | 3559 | A.mC.mU.mU. G.mC. A.mC.mU. A.mC. A. A. A.Chl | 3560 | P.mU.fU.fU. G.fU. A. G.fU. G.fC. A. A. G*fU*fC* A* A* A* C. | 80% |
| 18582 | 2267 | 3561 | G. A. A.mU.mU.mU. A.mU.mU. A. G.mU. A.Chl | 3562 | P.mU. A.fC.fU. A. A.fU. A. A. A.fU.fU.fC*fU*fU*fC*f C* A* G. | 82% |
| 18583 | 2267 | 3563 | A. G. A. A.mU.mU.mU. A.mU.mU. A. G.mU. A.Chl | 3564 | P.mU. A.fC.fU. A. A.fU. A. A. A.fU.fU.fC*fU*fU*fC*f C* A* G. | 67% |
| 18584 | 3184 | 3565 | mU.mU. G.mC. A.mC.mU. A.mC. A. A. A. A.Chl | 3566 | P.mU.fU.fU.fU. G.fU. A. G.fU. G.fC. A. A* G*fU*fC* A* A. | 77% |
| 18585 | 3184 | 3567 | mC.mU.mU. G.mC. A.mC.mU. A.mC. A. A. A. A.Chl | 3568 | P.mU.fU.fU.fU. G.fU. A. G.fU. G.fC. A. A* G*fU*fC* A* A. | 59% |
| 18586 | 2493 | 3569 | A.mU. A. A. A. A.mC. A. G. G.mU. G. A.Chl | 3570 | P.mU.fC. A.fC.fC.fU. G.fU.fU.fU.fU. A.fU*fU*fU*fU*fC*fC * A. | 84% |
| 18587 | 2493 | 3571 | A. A.mU. A. A. A. A.mC. A. G. G.mU. G. A.Chl | 3572 | P.mU.fC. A.fC.fC.fU. G.fU.fU.fU.fU. A.fU*fU*fU*fU*fC*fC * A. | 70% |
| 18588 | 2297 | 3573 | G. A.mC. A. A.mC. A. A.mC. A. A.mC. A.Chl | 3574 | P.mU. G.fU.fU. G.fU.fU. G.fU.fU. G.fU.fC* G*fU*fU* G*fU* U. | 40% |

TABLE 21-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 18589 | 2046 | 3575 | A.mU. G. C.mU.mU. G.mU. A. A.mC. A. A.Chl | 3576 | P.mU.fU. G.fU.fU. A.fC. A. A. G.fC. A.fU*fC* A*fU*fC* G* U. | 39% |
| 18590 | 2531 | 3577 | mC. A. G. A. A. A.mC.mU.mC. A.mU. G. A.Chl | 3578 | P.mU.fC. A.fU. G. A. G.fU.fU.fU.fC.fU. G* G*fC* A* A* A* G. | 56% |
| 18591 | 2389 | 3579 | G.mU. A.mU.mU. G.mC.mU. A.mU. G.mC. A.Chl | 3580 | P.mU. G.fC. A.fU. A. G.fC. A. A.fU. A.fC* A* G* A* A* A* A. | 64% |
| 18592 | 2530 | 3581 | mC.mC. A. G. A. A. A.mC.mU.mC. A.mU. A.Chl | 3582 | P.mU. A.fU. G. A. G.fU.fU.fU.fC.fU. G. G*fC* A* A* A* G* U. | 44% |
| 18593 | 2562 | 3583 | A.mC.mU.mC. A. A. A.mC. G. A. G.mC. A.Chl | 3584 | P.mU. G.fC.fU.fC. G.fU.fU.fU. G. A. G.fU*fU*fC* A* A* G* U. | 87% |
| 18594 | 2623 | 3585 | A.mU. A.mU. G. A.mC.mC. G. A. G. A. A.Chl | 3586 | P.mU.fU.fC.fU.fC. G. G.fU.fC. A.fU. A.fU* A* A*fU* A* A* C. | 69% |
| 18595 | 2032 | 3587 | mC. G. A.mC. G. A.mC. A. A.mC. G. A. A.Chl | 3588 | P.mU.fU.fC. G.fU.fU. G.fU.fC. G.fU.fC. G*fU*fC* A*fU*fC* A. | 55% |
| 18596 | 2809 | 3589 | G.mU. A. A. A.mC.mC. A. G.mU. G. A. A.Chl | 3590 | P.mU.fU.fC. A.fC.fU. G. G.fU.fU.fU. A.fC*fU A* A* A*fC* U. | 58% |
| 18597 | 2798 | 3591 | mU.mU. G.mU.mC. A. G.mU.mU.mU. A. G. A.Chl | 3592 | P.mU.fC.fU. A. A. A.fC.fU. G. A.fC. A. A* A* G* A* A*fC* C. | 38% |
| 18598 | 2081 | 3593 | mU.mC. A.mU.mC. A. G.mU. G.mU.mU. A. A.Chl | 3594 | P.mU.fU. A. A.fC. A.fC.fU. G. A.fU. G. A* A*fC*fC* A* A* G. | 25% |
| 18599 | 2561 | 3595 | A. A.mC.mU.mC. A. A. A.mC. G. A. G. A.Chl | 3596 | P.mU.fC.fU.fC. G.fU.fU.fU. G. A. G.fU.fU*fC* A* A* G*fU* U. | 57% |
| 18600 | 2296 | 3597 | mC. G. A.mC. A. A.mC. A. A.mC. A. A. A.Chl | 3598 | P.mU.fU.fU. G.fU.fU. G.fU.fU. G.fU.fC. G*fU*fU* G*fU*fU* C. | 69% |
| 18601 | 2034 | 3599 | A.mC. G. A.mC. A. A.mC. G. A.mU. G. A.Chl | 3600 | P.mU.fC. A.fU.fC. G.fU.fU. G.fU.fC. G.fU*fC* G*fU*fC* A*fU. | 22% |
| 18602 | 2681 | 3601 | G.mC.mU. G.mC.mC.mU. A. A. G. G. A. A.Chl | 3602 | P.mU.fU.fC.fC.fU.fU. A. G. G.fC. A. G.fC*fU* G* A*fU* A* C. | 43% |
| 18603 | 2190 | 3603 | A.mU.mU.mC.mU. A.mC. A.mU.mU.mU.mC. A.Chl | 3604 | P.mU. G. A. A. A.fU. G.fU. A. G. A. A.fU* A* G* G*fC* C. | 128% |
| 20604 | 2083 | 3605 | mC. A.mU.mC. A. G.mU. G.mU.mU. A. A. A. A.Chl | 3606 | P.mU.fU.fU.fU. A. A.fC. A.fC.fU. G. A.mU* G* A* A*mC*mC* A. | 19% |
| 20605 | 2083 | 3607 | mC. A.mU.mC. A. G.mU. G.mU.mU. | 3608 | P.mU.fU.fU.fU. A. A.fC. A.fC.fU. G. | 20% |

TABLE 21-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| | | | A. A. A. A.Chl | | A.mU* G* A* A*fC*mC* A. | |
| 20606 | 2083 | 3609 | mC. A.mU.mC. A. G.mU. G.mU.mU. A. A. A. A.Chl | 3610 | P.mU. U. U. U. A. A. C. A. C. U. G. A.mU* G* A* A*mC*mC* A. | 82% |
| 20607 | 2083 | 3611 | mC. A.mU.mC. A. G.mU. G.mU.mU. A. A. A. A.Chl | 3612 | P.mU.fU.fU.fU. A. A.fC. A.fC.fU. G. A.fU*mG*mA*mA*fC*fC* A. | 59% |
| 21722 | 2081 | 3613 | mU.mC. A.mU.mC. A. G.mU. G.mU.mU. A. A.Chl | 3614 | P.mU.fU. A. A.fC. A.fC.fU. G. A.fU. G. A* A*mC*mC* A* A* G. | 34% |
| 21723 | 2081 | 3615 | mU.mC. A.mU.mC. A. G.mU. G.mU.mU. A. A.Chl | 3616 | P.mU.fU. A. A.fC. A.fC.fU. G. A.fU. G.mA*mA*mC*mC*mA*mA* G. | 53% |
| 21724 | 2081 | 3617 | mU.mC. A.mU.mC. A. G.mU. G.mU.mU. A. A.Chl | 3618 | P.mU.fU. A. A.fC. A.fC.fU. G. A.mU. G.mA*mA*mC*mC*mA*mA* G. | 48% |
| 21725 | 2081 | 3619 | mU.mC. A.mU.mC. A. G.mU. G.mU.mU. A. A.Chl | 3620 | P.mU.fU. A. A.fC. A.fC.fU. G. A.fU. G. A* A*fC*fC*mA*mA* G. | 45% |
| 21726 | 2081 | 3621 | mU.mC. A.mU.mC. A. G.mU. G.mU.mU. A. A.Chl | 3622 | P.mU.fU. A. A.fC. A.fC.fU. G. A.fU. G.mA*mA*fC*fC*mA*mA* G. | 54% |
| 21727 | 2081 | 3623 | mU.mC. A.mU.mC. A. G.mU. G.mU.mU*mA*mA. TEG-Chl | 3624 | P.mU.fU. A. A.fC. A.fC.fU. G. A.fU. G. A* A*fC*fC* A* A* G. | 29% |
| 21728 | 2081 | 3625 | mU*mC* A.mU.mC. A. G.mU. G.mU.mU*mA*mA. TEG-Chl | 3626 | P.mU.fU. A. A.fC. A.fC.fU. G. A.fU. G. A* A*fC*fC* A* A* G. | 27% |
| 21729 | 2081 | 3627 | mU*mC*mA.mU.mC.mA.mG.mU.mG.mU.mU*mA*mA.TEG-Chl | 3628 | P.mU.fU. A. A.fC. A.fC.fU. G. A.fU. G. A* A*fC*fC* A* A* G. | 30% |
| 21375 | 2081 | 3629 | mU.mC. A.mU.mC. A. G.mU. G.mU.mU*mA*mA. TEG-Chl | 3630 | P.mU.fU. A. A.fC. A.fC.fU. G. A.fU. G. A* A*mC*mC* A* A* G. | 29% |
| 21376 | 2081 | 3631 | mU.mC. A.mU.mC. A. G.mU. G.mU.mU*mA*mA. TEG-Chl | 3632 | P.mU.fU. A. A.fC. A.fC.fU. G. A.fU. G. A* A*fC*fC*mA*mA* G. | 30% |
| 21377 | 2081 | 3633 | mU.mC. A.mU.mC. A. G.mU. G.mU.mU*mA*mA. TEG-Chl | 3634 | P.mU.fU. A. A.fC. A.fC.fU. G. A.fU. G.mA*mA*fC*fC*mA*mA* G. | 37% |
| 21378 | 2081 | 3635 | mU*mC*mA.mU.mC.mA.mG.mU.mG.mU.mU*mA*mA.TEG-Chl | 3636 | P.mU.fU. A. A.fC. A.fC.fU. G. A.fU. G. A* A*mC*mC* A* A* G. | 32% |

TABLE 21-continued

Inhibition of gene expression with TGFB2 sd-rxRNA sequences
(Accession Number: NM_001135599.1)

| Oligo Number | Start Site | SEQ ID NO | Sense sequence | SEQ ID NO | Antisense sequence | % remaining expression (1 uM, A549) |
|---|---|---|---|---|---|---|
| 21379 | 2081 | 3637 | mU*mC*mA.mU.mC.mA.mG.mU.mG.mU.mU*mA*mA.TEG-Chl | 3638 | P.mU.fU. A. A.fC. A.fC.fU. G. A.fU. G. A*A*fC*fC*mA*mA* G. | 31% |
| 21380 | 2081 | 3639 | mU*mC*mA.mU.mC.mA.mG.mU.mG.mU.mU*mA*mA.TEG-Chl | 3640 | P.mU.fU. A. A.fC. A.fC.fU. G. A.fU. G.mA*mA*fC*fC*mA*mA* G. | 39% |

TABLE 22

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| 14394 | 1194 | 3641 | G.mC.mU. A. A.mU. G. G.mU. G. G. A. A.Chl | 3642 | P.mU.fU.fC.fC. A.fC.fC. A.fU.fU. A. G.mC*A*mC* G*mC* G* G. | 24% |
| 14395 | 2006 | 3643 | mU. G. A.mU.mC. G.mU. G.mC. G.mC.mU.mC.Chl | 3644 | P.mG. A. G.fC. G.fC. A.fC. G. A.mU.mC. A*mU* G*mU*mU* G* G. | 79% |
| 14396 | 1389 | 3645 | mC. A. A.mU.mU.mC.mC.mU. G. G.mC. G. A.Chl | 3646 | P.mU.fC. G.fC.fC. A. G. G. A. A.mU.mU. G*mU*mU* G*mC*mU* G. | 77% |
| 14397 | 1787 | 3647 | A. G.mU. G. G. A.mU.mC.mC. A.mC. G. A.Chl | 3648 | P.mU.fC. G.fU. G. G. A.fU.fC.fC. A.mC.mU*mU*mC*mC * A* G* C. | n/a |
| 14398 | 1867 | 3649 | mU. A.mC. A. G.mC. A. A. G. G.mU.mC.mC.Chl | 3650 | P.mG. G. A.fC.fC.fU.fU. G.fC.fU. G.mU. A*mC*mU* G*mC* G* U. | 82% |
| 14399 | 2002 | 3651 | A. A.mC. A.mU. G. A.mU.mC. G.mU. G.mC.Chl | 3652 | P.mG.fC. A.fC. G. A.fU.fC. A.fU. G.mU.mU* G* G* A*mC* A* G. | n/a |
| 14400 | 2003 | 3653 | A.mC. A.mU. G. A.mU.mC. G.mU. G.mC. G.Chl | 3654 | P.mC. G.fC. A.fC. G. A.fU.fC. A.mU. G.mU*mU* G* G* A*mC* A. | n/a |
| 14401 | 1869 | 3655 | mC. A. G.mC. A. A. G. G.mU.mC.mC.mU. G.Chl | 3656 | P.mC. A. G. G. A.fC.fC.fU.fU. G.mC.mU. G*mU* A*mC*mU* G* C. | 82% |
| 14402 | 2000 | 3657 | mC.mC. A. A.mC. A.mU. G. A.mU.mC. G.mU.Chl | 3658 | P.mA.fC. G. A.fU.fC. A.fU. G.fU.mU. G* A*mC* A* G*mC* U. | 66% |
| 14403 | 986 | 3659 | A. G.mC. G. G. A. A. G.mC. G.mC. A.mU.Chl | 3660 | P.mA.fU. G.fC. G.fC.fU.fU.fC.fC. G.mC.mU*mU*mC* A*mC* A. | 78% |
| 14404 | 995 | 3661 | G.mC. A.mU.mC. G. A. G. G.mC.mC. | 3662 | P.mA.fU. G. G.fC.fC.fU.fC. G. A.mU. | 79% |

TABLE 22-continued

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| | | | A.mU.Chl | | G.mC* G*mC*mU*mU*mC* C. | |
| 14405 | 963 | 3663 | G. A.mC.mU. A.mU.mC. G. A.mC. A.mU. G.Chl | 3664 | P.mC. A.fU. G.fU.fC. G. A.fU. A. G.mU.mC*mU*mU* G*mC* A* G. | 80% |
| 14406 | 955 | 3665 | A.mC.mC.mU. G.mC. A. A. G. A.mC.mU. A.Chl | 3666 | P.mU. A. G.fU.fC.fU.fU. G.fC. A. G. G.mU* G* G* A*mU* A* G. | 88% |
| 14407 | 1721 | 3667 | G.mC.mU.mC.mC. A.mC. G. G. A. G. A. A.Chl | 3668 | P.mU.fU.fC.fU.fC.fC. G.fU. G. G. A. G.mC*mU* G* A* A* G* C. | n/a |
| 18454 | 1246 | 3669 | mC. A.mC. A. G.mC. A.mU. A.mU. A.mU. A.Chl | 3670 | P.mU. A.fU. A.fU. A.fU. G.fC.fU. G.fU. G*fU* G*fU* A*fC* U. | 58% |
| 18455 | 1248 | 3671 | mC. A. G.mC. A.mU. A.mU. A.mU. A.mU. A.Chl | 3672 | P.mU. A.fU. A.fU. A.fU. A.fU. G.fC.fU. G*fU* G*fU* G*fU* A. | 87% |
| 18456 | 1755 | 3673 | G.mU. A.mC. A.mU.mU. G. A.mC.mU.mU. A.Chl | 3674 | P.mU. A. A. G.fU.fC. A. A.fU. G.fU. A.fC* A* G*fC*fU* G* C. | 107% |
| 18457 | 1755 | 3675 | mU. G.mU. A.mC. A.mU.mU. G. A.mC.mU.mU. A.Chl | 3676 | P.mU. A. A. G.fU.fC. A. A.fU. G.fU. A.fC* A* G*fC*fU* G* C. | 77% |
| 18458 | 1708 | 3677 | A. A.mC.mU. A.mU.mU. G.mC.mU.mU.mC. A.Chl | 3678 | P.mU. G. A. A. G.fC. A. A.fU. A. G.fU.fU* G* G*fU* G*fU* C. | 75% |
| 18459 | 1708 | 3679 | mC. A. A.mC.mU. A.mU.mU. G.mC.mU.mU.mC. A.Chl | 3680 | P.mU. G. A. A. G.fC. A. A.fU. A. G.fU.fU* G* G*fU* G*fU* C. | 73% |
| 18460 | 1250 | 3681 | G.mC. A.mU. A.mU. A.mU. A.mU. G.mU. A.Chl | 3682 | P.mU. A.fC. A.fU. A.fU. A.fU. A.fU. G.fC*fU* G*fU* G*fU* G. | n/a |
| 18461 | 1754 | 3683 | mU. G.mU. A.mC. A.mU.mU. G. A.mC.mU. A.Chl | 3684 | P.mU. A. G.fU.fC. A. A.fU. G.fU. A.fC. A* G*fC*fU* G*fC* C. | 91% |
| 18462 | 1754 | 3685 | mC.mU. G.mU. A.mC. A.mU.mU. G. A.mC.mU. A.Chl | 3686 | P.mU. A. G.fU.fC. A. A.fU. G.fU. A.fC. A* G*fC*fU* G*fC* C. | 92% |
| 18463 | 1249 | 3687 | A. G.mC. A.mU. A.mU. A.mU. A.mU. G. A.Chl | 3688 | P.mU.fC. A.fU. A.fU. A.fU. A.fU. G.fC.fU* G*fU* G*fU* G* U. | n/a |
| 18464 | 1383 | 3689 | mC. A. G.mC. A. A.mC. A. A.mU.mU.mC. A.Chl | 3690 | P.mU. G. A. A.fU.fU. G.fU.fU. G.fC.fU. G*fU* A*fU*fU*fU* C. | 77% |
| 18465 | 1251 | 3691 | mC. A.mU. A.mU. A.mU. A.mU. G.mU.mU. A.Chl | 3692 | P.mU. A. A.fC. A.fU. A.fU. A.fU. A.fU. G*fC*fU* G*fU* G* U. | 84% |
| 18466 | 1713 | 3693 | mU.mU. G.mC.mU.mU.mC. A. G.mC.mU.mC. A.Chl | 3694 | P.mU. G. A. G.fC.fU. G. A. A. G.fC. A. A*fU* A* G*fU*fU* G. | n/a |

TABLE 22-continued

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| 18467 | 1713 | 3695 | A.mU.mU. G.mC.mU.mC. A. G.mC.mU.mC. A.Chl | 3696 | P.mU. G. A. G.fC.fU. G. A. A. G.fC. A. A*fU* A* G*fU*fU* G. | 83% |
| 18468 | 1247 | 3697 | A.mC. A. G.mC. A.mU. A.mU. A.mU. A. A.Chl | 3698 | P.mU.fU. A.fU. A.fU. A.fU. G.fC.fU. G.fU* G*fU* G*fU* A* C. | 96% |
| 18469 | 1712 | 3699 | A.mU.mU. G.mC.mU.mU.mC. A. G.mC.mU. A.Chl | 3700 | P.mU. A. G.fC.fU. G. A. A. G.fC. A. A.fU* A* G*fU*fU* G* G. | 90% |
| 18470 | 1712 | 3701 | mU. A.mU.mU. G.mC.mU.mC. A. G.mC.mU. A.Chl | 3702 | P.mU. A. G.fC.fU. G. A. A. G.fC. A. A.fU* A* G*fU*fU* G* G. | 98% |
| 18471 | 1212 | 3703 | mC. A. A. G.mU.mU.mC. A. G.mC. A. A.Chl | 3704 | P.mU.fU. G.fC.fU.fU. G. A. A.fC.fU.fU. G*fU*fC* A*fU* A* G. | n/a |
| 18472 | 1222 | 3705 | mC. A. G. A. G.mU. A.mC. A.mC. A.Chl | 3706 | P.mU. G.fU. G.fU. G.fU. A.fC.fU.fC.fU. G* C*fU*fU* G* A* A. | 45% |
| 18473 | 1228 | 3707 | A.mC. A.mC. A.mC. A. G.mC. A.mU. A. A.Chl | 3708 | P.mU.fU. A.fU. G.fC.fU. G.fU. G.fU. G.fU* A*fC*fU*fC*fU* G. | 36% |
| 18474 | 1233 | 3709 | mC. A. G.mC. A.mU. A.mU. A.mU. A.mU. A.Chl | 3710 | P.mU. A.fU. A.fU. A.fU. A.fU. G.fC.fU. G*fU* G*fU* G*fU* A. | 68% |
| 18475 | 1218 | 3711 | mU.mC. A. A. G.mC. A. G. A. G.mU. A. A.Chl | 3712 | P.mU.fU. A.fC.fU.fC.fU. G.fC.fU.fU. G. A* A*fC*fU*fU* G* U. | 64% |
| 18476 | 1235 | 3713 | A. G.mC. A.mU. A.mU. A.mU. A.mU. G. A.Chl | 3714 | P.mU.fC. A.fU. A.fU. A.fU. A.fU. G.fC.fU* G*fU* G*fU* G* U. | 78% |
| 18477 | 1225 | 3715 | A. G. A. G.mU. A.mC. A.mC. A.mC. A. A.Chl | 3716 | P.mU.fU. G.fU. G.fU. G.fU. A.fC.fU.fC.fU* G*fC*fU*fU* G* A. | 92% |
| 18478 | 1221 | 3717 | A. A. G.mC. A. G. A. G.mU. A.mC. A. A.Chl | 3718 | P.mU.fU. G.fU. A.fC.fU.fC.fU. G.fC.fU.fU* G* A* A*fC*fU* U. | 103% |
| 18479 | 1244 | 3719 | mU.mU.mC. A. A.mC. A.mC. A.mU.mC. A. A.Chl | 3720 | P.mU.fU. G. A.fU. G.fU. G.fU.fU. G. A. A* G* A* A*fC* A* U. | 84% |
| 18480 | 1224 | 3721 | A. G.mC. A. G. A. G.mU. A.mC. A.mC. A.Chl | 3722 | P.mU. G.fU. G.fU. A.fC.fU.fC.fU. G.fC.fU*fU* G* A* A*fC* U. | 37% |
| 18481 | 1242 | 3723 | A.mU. A.mU. A.mU. G.mU.mU.mC.mU.m U. A.Chl | 3724 | P.mU. A. A. G. A. A.fC. A.fU. A.fU. A.fU* A*fU* G*fC*fU* G. | 62% |
| 18482 | 1213 | 3725 | G. A.mC. A. A. G.mU.mU.mC. A. A. G. A.Chl | 3726 | P.mU.fC.fU.fU. G. A. A.fC.fU.fU. G.fU.fC* A*fU* A* G* A* U. | 47% |
| 18483 | 1760 | 3727 | mU.mU. A. A. A. G. A.mU. G. G. A. G.A.Chl | 3728 | P.mU.fC.fU.fC.fC. A.fU.fC.fU.fU.fU. A. A*fU* G* G* G* C. | 69% |
| 18484 | 1211 | 3729 | mC.mU. A.mU. G. A.mC. A. A. G.mU.mU. A.Chl | 3730 | P.mU. A. A.fC.fU.fU. G.fU.fC. A.fU. A. G* A*fU*fU*fU*fC* G. | n/a |

TABLE 22-continued

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| 19411 | 1212 | 3731 | mC. A. A.mC. G. A. A. A.mU.mC.mU. A. A.Chl | 3732 | P.mU.fU. A. G. A.fU.fU.fU.fC. G.fU.fU. G*fU* G* G* G*fU*fU. | 52% |
| 19412 | 1222 | 3733 | mU. A.mU. G. A.mC. A. A. G.mU.mU.mC. A.Chl | 3734 | P.mU. G. A. A.fC.fU.fU. G.fU.fC. A.fU. A* G* A*fU*fU*fU*fC. | 51% |
| 19413 | 1228 | 3735 | A. A. G.mU.mU.mC. A. A. G.mC. A. G. A.Chl | 3736 | P.mU.fC.fU. G.fC.fU.fU. G. A. A.fC.fU.fU* G*fU*fC* A*fU* A. | n/a |
| 19414 | 1233 | 3737 | mC. A. A. G.mC. A. G. A. G.mU. A.mC. A.Chl | 3738 | P.mU. G.fU. A.fC.fU.fC.fU. G.fC.fU.fU. G* A* A*fC*fU*fU* G. | 41% |
| 19415 | 1218 | 3739 | A. A.mU.mC.mU. A.mU. G. A.mC. A. A. A.Chl | 3740 | P.mU.fU.fU. G.fU.fC. A.fU. A. G. A.fU. fU*fU*fC* G*fU*fU* G. | 104% |
| 19416 | 1244 | 3741 | mC. A.mC. A.mC. A. G.mC. A.mU. A.mU. A.Chl | 3742 | P.mU. A.fU. A.fU. G.fC.fU. G.fU. G.fU. G*fU* A*fC*fU*fC*fU. | 31% |
| 19417 | 655 | 3743 | G. A. A. A.mU. A.mU. A. G.mC. A. A. A.Chl | 3744 | P.mU.fU.fU. G.fC.fU. A.fU. A.fU.fU.fU.fC*fU* G* G*fU* A* G. | n/a |
| 19418 | 644 | 3745 | G. A. A.mC.mU.mU. A.mC.mC. A. G. A.Chl | 3746 | P.mU.fC.fU. G. G.fU. A. G. A.fC.fU.fU*fU* A*fC* G*fU* G. | n/a |
| 19419 | 819 | 3747 | G.mC. A. A. A. G. A.mU. A. A.mU. G. A.Chl | 3748 | P.mU.fC. A.fU.fU. A.fU.fC.fU.fU.fU. G.fC*fU* G*fU*fC* A* C. | n/a |
| 19420 | 645 | 3749 | A. A.mC.mU.mC.mU. A.mC.mC. A. G. A. A.Chl | 3750 | P.mU.fU.fC.fU. G. G.fU. A. G. A. G.fU. fU*fC*fU* A*fC* G* U. | n/a |
| 19421 | 646 | 3751 | A.mC.mU.mC.mU. A.mC.mC. A. G. A. A. A.Chl | 3752 | P.mU.fU.fU.fC.fU. G. G.fU. A. G. A. G.fU*fU*fC*fU* A*fC* G. | n/a |
| 19422 | 816 | 3753 | A.mC. A. G.mC. A. A. A. G. A.mU. A. A.Chl | 3754 | P.mU.fU. A.fU.fC.fU.fU.fU. G.fC.fU. G.fU*fC* A*fC* A* A* G. | n/a |
| 19423 | 495 | 3755 | mC. A. A.mU.mC.mU. A.mU. G. A.mC. A. A.Chl | 3756 | P.mU.fU. G.fU.fC. A.fU. A. G. A.fU.fU. G*fC* G*fU*fU* G* U. | n/a |
| 19424 | 614 | 3757 | A. G. A.mU.mU.mC. A. A. G.mU.mC. A. A.Chl | 3758 | P.mU.fU. G. A.fC.fU.fU. G. A. A.fU.fC.fU*fC*fU* G*fC* A* G. | n/a |
| 19425 | 627 | 3759 | mC.mU. G.mU. G. G. A. G.mC. A. A.mC. A.Chl | 3760 | P.mU. G.fU.fU. G.fC.fU.fC.fC. A.fC. A. G*fU*fU* G* A*fC* U. | n/a |
| 19426 | 814 | 3761 | mU. G. A.mC. A. G.mC. A. A. A. G. A. A.Chl | 3762 | P.mU.fU.fC.fU.fU.fU. G.fC.fU. G.fU.fC. A*fC* A* A* G* A* G. | n/a |

TABLE 22-continued

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| 19427 | 501 | 3763 | A.mU. G. A.mC. A. A. A. A.mC.mC. A. A.Chl | 3764 | P.mU.fU. G. G.fU.fU.fU.fU. G.fU.fC. A.fU* A* G* A*fU*fU* G. | n/a |
| 19428 | 613 | 3765 | G. A. G. A.mU.mU.mC. A. A. G.mU.mC. A.Chl | 3766 | P.mU. G. A.fC.fU.fU. G. A. A.fU.fC.fU.fC*fU* G*fC* A* G* G. | n/a |
| 21240 | 1244 | 3767 | mC. A.mC. A.mC. A. G.mC. A.mU. A.mU. A.Chl | 3768 | P.mU. A.fU. A.fU. G.fC.fU. G.fU. G.fU. G*mU* A*mC*mU*mC* U. | 0.875 |
| 21241 | 1244 | 3769 | mC. A.mC. A.mC. A. G.mC. A.mU. A.mU. A.Chl | 3770 | P.mU. A.fU. A.fU. G.fC.fU. G.fU. G.fU. G*mU*mA*mC*mU*mC* U. | 0.88 |
| 21242 | 1244 | 3771 | mC. A.mC. A.mC. A. G.mC. A.mU. A.mU. A.Chl | 3772 | P.mU. A.fU. A.fU. G.fC.fU. G.fU. G.fU.mG*mU*mA*mC*mU*mC* U. | 0.635 |
| 21243 | 1244 | 3773 | mC. A.mC. A.mC. A. G.mC. A.mU. A.mU. A.Chl | 3774 | P.mU. A.fU. A.fU. G.fC.fU. G.fU. G.fU.mG*fU*mA*fC*mU*fC* U. | 0.32 |
| 21244 | 1244 | 3775 | mC. A.mC. A.mC. A. G.mC. A.mU. A.mU. A.Chl | 3776 | P.mU. A.fU. A.fU. G.fC.fU. G.fU. G.fU. G*fU* A*fC*mU*mC* U. | 0.36 |
| 21245 | 1244 | 3777 | mC. A.mC. A.mC. A. G.mC. A.mU. A*mU*mA.TEG-Chl | 3778 | P.mU. A.fU. A.fU. G.fC.fU. G.fU. G.fU. G*fU* A*fC*fU*fC*fU. | 0.265 |
| 21246 | 1244 | 3779 | mC*mA*mC. A.mC. A. G.mC. A.mU. A*mU*mA.TEG-Chl | 3780 | P.mU. A.fU. A.fU. G.fC.fU. G.fU. G.fU. G*fU* A*fC*fU*fC*fU. | 0.334 |
| 21247 | 1244 | 3781 | mC*mA*mC.mA.mC. mA.mG.mC.mA.mU. mA*mU*mA.TEG-Chl | 3782 | P.mU. A.fU. A.fU. G.fC.fU. G.fU. G.fU. G*fU* A*fC*fU*fC*fU. | 0.29 |
| 21248 | 614 | 3783 | mA. G. A.mU.mU.mC. A. A. G.mU.mC*mA*mA.TEG-Chl | 3784 | P.mU.fU. G. A.fC.fU.fU. G. A. A.fU.fC.fU*fC*fU* G*fC*fU* U. | n/a |
| 20608 | 1244 | 3785 | mC. A.mC. A.mC. A. G.mC. A.mU. A.mU. A.Chl | 3786 | P.mU. A.fU. A.fU. G.fC.fU. G.fU. G.mU. G*mU* A*mC*mU*mC* U. | 79% |
| 20609 | 1244 | 3787 | mC. A.mC. A.mC. A. G.mC. A.mU. A.mU. A.Chl | 3788 | P.mU. A.fU. A.fU. G.fC.fU. G.fU. G.mU. G*fU* A*mC*fU*mC* U. | 60% |
| 20610 | 1244 | 3789 | mC. A.mC. A.mC. A. G.mC. A.mU. A.mU. A.Chl | 3790 | P.mU. A. U. A. U. G. C. U. G. U. G.mU. G*mU* A*mC*mU*mC* U. | 93% |
| 20611 | 1244 | 3791 | mC. A.mC. A.mC. A. G.mC. A.mU. A.mU. A.Chl | 3792 | P.mU. A.fU. A.fU. G.fC.fU. G.fU. G.mU.mG*mU*mA*mC*mU*mC* U. | n/a |

TABLE 22-continued

Inhibition of gene expression with TGFB1 sd-rxRNA sequences
(Accession Number: NM_000660.3)

| Oligo Number | Start Site | SEQ ID NO | Sense sequence | SEQ ID NO | Antisense sequence | % remaining expression (1 uM A549) |
|---|---|---|---|---|---|---|
| 21374 | 614 | 3793 | mC*mA*mC.mA.mC.mA.mG.mC.mA.mU.mA*mU*mA.TEG-Chl | 3794 | P.mU. A.fU. A.fU. G.fC.fU. G.fU. G.fU.mG*fU*mA*fC*mU*fC* U. | 24% |

TABLE 23

CB1 sequences

| Ref Pos | SEQ ID NO | 19-mer Sense Seq | SEQ ID NO | 25-mer Sense Seq w/A @ 25 |
|---|---|---|---|---|
| 1690 | 3795 | AUGUCUGUGUCCACAGACA | 3796 | GUAACCAUGUCUGUGUCCACAGACA |
| 1686 | 3797 | AACCAUGUCUGUGUCCACA | 3798 | CAAGGUAACCAUGUCUGUGUCCACA |
| 1685 | 3799 | UAACCAUGUCUGUGUCCAC | 3800 | CCAAGGUAACCAUGUCUGUGUCCAA |
| 1684 | 3801 | GUAACCAUGUCUGUGUCCA | 3802 | GCCAAGGUAACCAUGUCUGUGUCCA |
| 1649 | 3803 | AAAGCUGCAUCAAGAGCAC | 3804 | CCGCAGAAAGCUGCAUCAAGAGCAA |
| 1648 | 3805 | GAAAGCUGCAUCAAGAGCA | 3806 | GCCGCAGAAAGCUGCAUCAAGAGCA |
| 1494 | 3807 | CAUCUAUGCUCUGAGGAGU | 3808 | CCCCAUCAUCUAUGCUCUGAGGAGA |
| 1493 | 3809 | UCAUCUAUGCUCUGAGGAG | 3810 | ACCCCAUCAUCUAUGCUCUGAGGAA |
| 1492 | 3811 | AUCAUCUAUGCUCUGAGGA | 3812 | AACCCCAUCAUCUAUGCUCUGAGGA |
| 1491 | 3813 | CAUCAUCUAUGCUCUGAGG | 3814 | GAACCCCAUCAUCUAUGCUCUGAGA |
| 1490 | 3815 | CCAUCAUCUAUGCUCUGAG | 3816 | UGAACCCCAUCAUCUAUGCUCUGAA |
| 1489 | 3817 | CCCAUCAUCUAUGCUCUGA | 3818 | GUGAACCCCAUCAUCUAUGCUCUGA |
| 1487 | 3819 | ACCCCAUCAUCUAUGCUCU | 3820 | CCGUGAACCCCAUCAUCUAUGCUCA |
| 1486 | 3821 | AACCCCAUCAUCUAUGCUC | 3822 | ACCGUGAACCCCAUCAUCUAUGCUA |
| 1358 | 3823 | UGGUGUUGAUCAUCUGCUG | 3824 | UCCUGGUGGUGUUGAUCAUCUGCUA |
| 1357 | 3825 | GUGGUGUUGAUCAUCUGCU | 3826 | AUCCUGGUGGUGUUGAUCAUCUGCA |
| 1355 | 3827 | UGGUGGUGUUGAUCAUCUG | 3828 | UGAUCCUGGUGGUGUUGAUCAUCUA |
| 1354 | 3829 | CUGGUGGUGUUGAUCAUCU | 3830 | CUGAUCCUGGUGGUGUUGAUCAUCA |
| 1351 | 3831 | AUCCUGGUGGUGUUGAUCA | 3832 | GUCCUGAUCCUGGUGGUGUUGAUCA |
| 1198 | 3833 | AUUCUCUGGAAGGCUCACA | 3834 | AUGUAUAUUCUCUGGAAGGCUCACA |
| 1197 | 3835 | UAUUCUCUGGAAGGCUCAC | 3836 | CAUGUAUAUUCUCUGGAAGGCUCAA |
| 1196 | 3837 | AUAUUCUCUGGAAGGCUCA | 3838 | ACAUGUAUAUUCUCUGGAAGGCUCA |
| 1195 | 3839 | UAUAUUCUCUGGAAGGCUC | 3840 | UACAUGUAUAUUCUCUGGAAGGCUA |
| 1131 | 3841 | CUACCUGAUGUUCUGGAUC | 3842 | UGAAACCUACCUGAUGUUCUGGAUA |
| 1129 | 3843 | ACCUACCUGAUGUUCUGGA | 3844 | GAUGAAACCUACCUGAUGUUCUGGA |
| 1127 | 3845 | AAACCUACCUGAUGUUCUG | 3846 | UUGAUGAAACCUACCUGAUGUUCUA |
| 1126 | 3847 | GAAACCUACCUGAUGUUCU | 3848 | AUUGAUGAAACCUACCUGAUGUUCA |
| 1086 | 3849 | ACUGCAAUCUGUUUGCUCA | 3850 | CGAGAAACUGCAAUCUGUUUGCUCA |
| 1084 | 3851 | AAACUGCAAUCUGUUUGCU | 3852 | UGCGAGAAACUGCAAUCUGUUUGCA |

TABLE 23-continued

CB1 sequences

| Ref Pos | SEQ ID NO | 19-mer Sense Seq | SEQ ID NO | 25-mer Sense Seq w/A @ 25 |
|---|---|---|---|---|
| 972 | 3853 | CCUGGCCUAUAAGAGGAUU | 3854 | CAGGCCCUGGCCUAUAAGAGGAUA |
| 951 | 3855 | GUACAUAUCCAUUCACAGG | 3856 | CGACAGGUACAUAUCCAUUCACAGA |
| 950 | 3857 | GGUACAUAUCCAUUCACAG | 3858 | UCGACAGGUACAUAUCCAUUCACAA |
| 948 | 3859 | CAGGUACAUAUCCAUUCAC | 3860 | CAUCGACAGGUACAUAUCCAUUCAA |
| 947 | 3861 | ACAGGUACAUAUCCAUUCA | 3862 | CCAUCGACAGGUACAUAUCCAUUCA |
| 946 | 3863 | GACAGGUACAUAUCCAUUC | 3864 | GCCAUCGACAGGUACAUAUCCAUUA |
| 943 | 3865 | AUCGACAGGUACAUAUCCA | 3866 | ACAGCCAUCGACAGGUACAUAUCCA |
| 941 | 3867 | CCAUCGACAGGUACAUAUC | 3868 | UCACAGCCAUCGACAGGUACAUAUA |
| 940 | 3869 | GCCAUCGACAGGUACAUAU | 3870 | CUCACAGCCAUCGACAGGUACAUAA |
| 869 | 3871 | ACGUGUUUCUGUUCAAACU | 3872 | GCCGCAACGUGUUUCUGUUCAAACA |
| 868 | 3873 | AACGUGUUUCUGUUCAAAC | 3874 | AGCCGCAACGUGUUUCUGUUCAAAA |
| 1647 | 3875 | AGAAAGCUGCAUCAAGAGC | 3876 | GGCCGCAGAAAGCUGCAUCAAGAGA |
| 1645 | 3877 | GCAGAAAGCUGCAUCAAGA | 3878 | AGGGCCGCAGAAAGCUGCAUCAAGA |
| 1394 | 3879 | UCAUGGUGUAUGAUGUCUU | 3880 | UUGCAAUCAUGGUGUAUGAUGUCUA |
| 1393 | 3881 | AUCAUGGUGUAUGAUGUCU | 3882 | CUUGCAAUCAUGGUGUAUGAUGUCA |
| 1391 | 3883 | CAAUCAUGGUGUAUGAUGU | 3884 | UGCUUGCAAUCAUGGUGUAUGAUGA |
| 1125 | 3885 | UGAAACCUACCUGAUGUUC | 3886 | CAUUGAUGAAACCUACCUGAUGUUA |
| 1090 | 3887 | CAAUCUGUUUGCUCAGACA | 3888 | AAACUGCAAUCUGUUUGCUCAGACA |
| 1089 | 3889 | GCAAUCUGUUUGCUCAGAC | 3890 | GAAACUGCAAUCUGUUUGCUCAGAA |
| 1088 | 3891 | UGCAAUCUGUUUGCUCAGA | 3892 | AGAAACUGCAAUCUGUUUGCUCAGA |
| 1087 | 3893 | CUGCAAUCUGUUUGCUCAG | 3894 | GAGAAACUGCAAUCUGUUUGCUCAA |
| 1397 | 3895 | UGGUGUAUGAUGUCUUUGG | 3896 | CAAUCAUGGUGUAUGAUGUCUUUGA |
| 1396 | 3897 | AUGGUGUAUGAUGUCUUUG | 3898 | GCAAUCAUGGUGUAUGAUGUCUUUA |
| 1120 | 3899 | AUUGAUGAAACCUACCUGA | 3900 | CCACACAUUGAUGAAACCUACCUGA |
| 1118 | 3901 | ACAUUGAUGAAACCUACCU | 3902 | UCCCACACAUUGAUGAAACCUACCA |
| 1117 | 3903 | CACAUUGAUGAAACCUACC | 3904 | UUCCCACACAUUGAUGAAACCUACA |
| 1116 | 3905 | ACACAUUGAUGAAACCUAC | 3906 | UUUCCCACACAUUGAUGAAACCUAA |
| 1132 | 3907 | UACCUGAUGUUCUGGAUCG | 3908 | GAAACCUACCUGAUGUUCUGGAUCA |
| 845 | 3909 | UGUUCCACCGCAAAGAUAG | 3910 | UCCACGUGUUCCACCGCAAAGAUAA |
| 844 | 3911 | GUGUUCCACCGCAAAGAUA | 3912 | UUCCACGUGUUCCACCGCAAAGAUA |
| 573 | 3913 | CUUCAAGGAGAAUGAGGAG | 3914 | CUCGUCCUUCAAGGAGAAUGAGGAA |
| 572 | 3915 | CCUUCAAGGAGAAUGAGGA | 3916 | UCUCGUCCUUCAAGGAGAAUGAGGA |
| 571 | 3917 | UCCUUCAAGGAGAAUGAGG | 3918 | CUCUCGUCCUUCAAGGAGAAUGAGA |
| 1449 | 3919 | AUUCUGCAGUAUGCUCUGC | 3920 | GUUUGCAUUCUGCAGUAUGCUCUGA |
| 1448 | 3921 | CAUUCUGCAGUAUGCUCUG | 3922 | UGUUUGCAUUCUGCAGUAUGCUCUA |
| 1447 | 3923 | GCAUUCUGCAGUAUGCUCU | 3924 | GUGUUUGCAUUCUGCAGUAUGCUCA |
| 1253 | 3925 | AGAGCAUCAUCAUCCACAC | 3926 | CCCAGAAGAGCAUCAUCAUCCACAA |
| 1252 | 3927 | AAGAGCAUCAUCAUCCACA | 3928 | ACCCAGAAGAGCAUCAUCAUCCACA |

TABLE 23-continued

CB1 sequences

| Ref Pos | SEQ ID NO | 19-mer Sense Seq | SEQ ID NO | 25-mer Sense Seq w/A @ 25 |
|---|---|---|---|---|
| 1247 | 3929 | CCCAGAAGAGCAUCAUCAU | 3930 | GUGGCACCCAGAAGAGCAUCAUCAA |
| 1246 | 3931 | ACCCAGAAGAGCAUCAUCA | 3932 | CGUGGCACCCAGAAGAGCAUCAUCA |
| 311 | 3933 | UGAAGUCGAUCCUAGAUGG | 3934 | AGGUUAUGAAGUCGAUCCUAGAUGA |
| 310 | 3935 | AUGAAGUCGAUCCUAGAUG | 3936 | GAGGUUAUGAAGUCGAUCCUAGAUA |
| 1249 | 3937 | CAGAAGAGCAUCAUCAUCC | 3938 | GGCACCCAGAAGAGCAUCAUCAUCA |
| 585 | 3939 | UGAGGAGAACAUCCAGUGU | 3940 | GGAGAAUGAGGAGAACAUCCAGUGA |
| 583 | 3941 | AAUGAGGAGAACAUCCAGU | 3942 | AAGGAGAAUGAGGAGAACAUCCAGA |
| 581 | 3943 | AGAAUGAGGAGAACAUCCA | 3944 | UCAAGGAGAAUGAGGAGAACAUCCA |
| 580 | 3945 | GAGAAUGAGGAGAACAUCC | 3946 | UUCAAGGAGAAUGAGGAGAACAUCA |
| 579 | 3947 | GGAGAAUGAGGAGAACAUC | 3948 | CUUCAAGGAGAAUGAGGAGAACAUA |
| 578 | 3949 | AGGAGAAUGAGGAGAACAU | 3950 | CCUUCAAGGAGAAUGAGGAGAACAA |
| 577 | 3951 | AAGGAGAAUGAGGAGAACA | 3952 | UCCUUCAAGGAGAAUGAGGAGAACA |
| 574 | 3953 | UUCAAGGAGAAUGAGGAGA | 3954 | UCGUCCUUCAAGGAGAAUGAGGAGA |
| 1257 | 3955 | CAUCAUCAUCCACACGUCU | 3956 | GAAGAGCAUCAUCAUCCACACGUCA |
| 1255 | 3957 | AGCAUCAUCAUCCACACGU | 3958 | CAGAAGAGCAUCAUCAUCCACACGA |
| 1682 | 3959 | AGGUAACCAUGUCUGUGUC | 3960 | UUGCCAAGGUAACCAUGUCUGUGUA |
| 1681 | 3961 | AAGGUAACCAUGUCUGUGU | 3962 | AUUGCCAAGGUAACCAUGUCUGUGA |
| 1680 | 3963 | CAAGGUAACCAUGUCUGUG | 3964 | GAUUGCCAAGGUAACCAUGUCUGUA |
| 1499 | 3965 | AUGCUCUGAGGAGUAAGGA | 3966 | UCAUCUAUGCUCUGAGGAGUAAGGA |
| 1498 | 3967 | UAUGCUCUGAGGAGUAAGG | 3968 | AUCAUCUAUGCUCUGAGGAGUAAGA |
| 1497 | 3969 | CUAUGCUCUGAGGAGUAAG | 3970 | CAUCAUCUAUGCUCUGAGGAGUAAA |
| 1496 | 3971 | UCUAUGCUCUGAGGAGUAA | 3972 | CCAUCAUCUAUGCUCUGAGGAGUAA |
| 1388 | 3973 | UUGCAAUCAUGGUGUAUGA | 3974 | CUCUGCUUGCAAUCAUGGUGUAUGA |
| 1387 | 3975 | CUUGCAAUCAUGGUGUAUG | 3976 | CCUCUGCUUGCAAUCAUGGUGUAUA |
| 1386 | 3977 | GCUUGCAAUCAUGGUGUAU | 3978 | CCCUCUGCUUGCAAUCAUGGUGUAA |
| 1385 | 3979 | UGCUUGCAAUCAUGGUGUA | 3980 | GCCCUCUGCUUGCAAUCAUGGUGUA |
| 1384 | 3981 | CUGCUUGCAAUCAUGGUGU | 3982 | GGCCCUCUGCUUGCAAUCAUGGUGA |
| 1383 | 3983 | UCUGCUUGCAAUCAUGGUG | 3984 | GGGCCCUCUGCUUGCAAUCAUGGUA |
| 1382 | 3985 | CUCUGCUUGCAAUCAUGGU | 3986 | GGGGCCCUCUGCUUGCAAUCAUGGA |
| 1314 | 3987 | CCGCAUGGACAUUAGGUUA | 3988 | CCAAGCCCGCAUGGACAUUAGGUUA |
| 1094 | 3989 | CUGUUUGCUCAGACAUUUU | 3990 | UGCAAUCUGUUUGCUCAGACAUUUA |
| 1093 | 3991 | UCUGUUUGCUCAGACAUUU | 3992 | CUGCAAUCUGUUUGCUCAGACAUUA |
| 1083 | 3993 | GAAACUGCAAUCUGUUUGC | 3994 | CUGCGAGAAACUGCAAUCUGUUUGA |
| 1082 | 3995 | AGAAACUGCAAUCUGUUUG | 3996 | ACUGCGAGAAACUGCAAUCUGUUUA |
| 1080 | 3997 | CGAGAAACUGCAAUCUGUU | 3998 | GAACUGCGAGAAACUGCAAUCUGUA |
| 323 | 3999 | UAGAUGGCCUUGCAGAUAC | 4000 | CGAUCCUAGAUGGCCUUGCAGAUAA |
| 322 | 4001 | CUAGAUGGCCUUGCAGAUA | 4002 | UCGAUCCUAGAUGGCCUUGCAGAUA |

TABLE 23-continued

| CB1 sequences | | | | |
|---|---|---|---|---|
| Ref Pos | SEQ ID NO | 19-mer Sense Seq | SEQ ID NO | 25-mer Sense Seq w/A @ 25 |
| 1179 | 4003 | CGUGUAUGCGUACAUGUAU | 4004 | GUUCAUCGUGUAUGCGUACAUGUAA |
| 1178 | 4005 | UCGUGUAUGCGUACAUGUA | 4006 | UGUUCAUCGUGUAUGCGUACAUGUA |
| 1177 | 4007 | AUCGUGUAUGCGUACAUGU | 4008 | CUGUUCAUCGUGUAUGCGUACAUGA |
| 1320 | 4009 | GGACAUUAGGUUAGCCAAG | 4010 | CCGCAUGGACAUUAGGUUAGCCAAA |
| 1319 | 4011 | UGGACAUUAGGUUAGCCAA | 4012 | CCCGCAUGGACAUUAGGUUAGCCAA |
| 1318 | 4013 | AUGGACAUUAGGUUAGCCA | 4014 | GCCCGCAUGGACAUUAGGUUAGCCA |
| 1317 | 4015 | CAUGGACAUUAGGUUAGCC | 4016 | AGCCCGCAUGGACAUUAGGUUAGCA |
| 1316 | 4017 | GCAUGGACAUUAGGUUAGC | 4018 | AAGCCCGCAUGGACAUUAGGUUAGA |
| 1315 | 4019 | CGCAUGGACAUUAGGUUAG | 4020 | CAAGCCCGCAUGGACAUUAGGUUAA |
| 1415 | 4021 | GGAAGAUGAACAAGCUCAU | 4022 | UCUUUGGAAGAUGAACAAGCUCAA |
| 552 | 4023 | UUACAACAAGUCUCUCUCG | 4024 | AGAAUUUACAACAAGUCUCUCUCA |
| 551 | 4025 | UUUACAACAAGUCUCUCUC | 4026 | CAGAAUUUACAACAAGUCUCUCUA |
| 550 | 4027 | UUUUACAACAAGUCUCUCU | 4028 | ACAGAAUUUACAACAAGUCUCUCA |
| 476 | 4029 | GUCCCUUCCAAGAGAAGAU | 4030 | GGGGAAGUCCCUUCCAAGAGAAGAA |
| 474 | 4031 | AAGUCCCUUCCAAGAGAAG | 4032 | UAGGGGAAGUCCCUUCCAAGAGAAA |
| 473 | 4033 | GAAGUCCCUUCCAAGAGAA | 4034 | UUAGGGGAAGUCCCUUCCAAGAGAA |
| 1020 | 4035 | UUGCCUGAUGUGGACCAUA | 4036 | GGCGUUUUGCCUGAUGUGGACCAUA |
| 1019 | 4037 | UUUGCCUGAUGUGGACCAU | 4038 | UGGCGUUUUGCCUGAUGUGGACCAA |
| 1018 | 4039 | UUUUGCCUGAUGUGGACCA | 4040 | GUGGCGUUUUGCCUGAUGUGGACCA |
| 606 | 4041 | GGAGAACUUCAUGGACAUA | 4042 | GUGUGGGAGAACUUCAUGGACAUA |
| 1568 | 4043 | AGCCUCUGGAUAACAGCAU | 4044 | CUGCGCAGCCUCUGGAUAACAGCAA |
| 1170 | 4045 | UCUGUUCAUCGUGUAUGCG | 4046 | ACUGCUUCUGUUCAUCGUGUAUGCA |
| 1169 | 4047 | UUCUGUUCAUCGUGUAUGC | 4048 | UACUGCUUCUGUUCAUCGUGUAUGA |
| 1168 | 4049 | CUUCUGUUCAUCGUGUAUG | 4050 | GUACUGCUUCUGUUCAUCGUGUAUA |
| 1421 | 4051 | UGAACAAGCUCAUUAAGAC | 4052 | GGAAGAUGAACAAGCUCAUUAAGAA |
| 1420 | 4053 | AUGAACAAGCUCAUUAAGA | 4054 | GGGAAGAUGAACAAGCUCAUUAAGA |
| 1419 | 4055 | GAUGAACAAGCUCAUUAAG | 4056 | UGGGAAGAUGAACAAGCUCAUUAAA |
| 1418 | 4057 | AGAUGAACAAGCUCAUUAA | 4058 | UUGGGAAGAUGAACAAGCUCAUUAA |
| 1417 | 4059 | AAGAUGAACAAGCUCAUUA | 4060 | UUUGGGAAGAUGAACAAGCUCAUUA |
| 1172 | 4061 | UGUUCAUCGUGUAUGCGUA | 4062 | UGCUUCUGUUCAUCGUGUAUGCGUA |
| 1078 | 4063 | UGCGAGAAACUGCAAUCUG | 4064 | UGGAACUGCGAGAAACUGCAAUCUA |
| 825 | 4065 | CAGCUUCAUUGACUUCCAC | 4066 | UGUCUACAGCUUCAUUGACUUCCAA |
| 824 | 4067 | ACAGCUUCAUUGACUUCCA | 4068 | UUGUCUACAGCUUCAUUGACUUCCA |
| 823 | 4069 | UACAGCUUCAUUGACUUCC | 4070 | UUUGUCUACAGCUUCAUUGACUUCA |
| 821 | 4071 | UCUACAGCUUCAUUGACUU | 4072 | UUUUUGUCUACAGCUUCAUUGACUA |
| 820 | 4073 | GUCUACAGCUUCAUUGACU | 4074 | AUUUUUGUCUACAGCUUCAUUGACA |
| 612 | 4075 | CUUCAUGGACAUAGAGUGU | 4076 | GGAGAACUUCAUGGACAUAGAGUGA |
| 611 | 4077 | ACUUCAUGGACAUAGAGUG | 4078 | GGGAGAACUUCAUGGACAUAGAGUA |

TABLE 23-continued

| CB1 sequences | | | | |
|---|---|---|---|---|
| Ref Pos | SEQ ID NO | 19-mer Sense Seq | SEQ ID NO | 25-mer Sense Seq w/A @ 25 |
| 610 | 4079 | AACUUCAUGGACAUAGAGU | 4080 | GGGGAGAACUUCAUGGACAUAGAGA |
| 549 | 4081 | AUUUUACAACAAGUCUCUC | 4082 | UACAGAAUUUUACAACAAGUCUCUA |
| 547 | 4083 | GAAUUUUACAACAAGUCUC | 4084 | AUUACAGAAUUUUACAACAAGUCUA |
| 1176 | 4085 | CAUCGUGUAUGCGUACAUG | 4086 | UCUGUUCAUCGUGUAUGCGUACAUA |
| 1175 | 4087 | UCAUCGUGUAUGCGUACAU | 4088 | UUCUGUUCAUCGUGUAUGCGUACAA |
| 1174 | 4089 | UUCAUCGUGUAUGCGUACA | 4090 | CUUCUGUUCAUCGUGUAUGCGUACA |
| 1173 | 4091 | GUUCAUCGUGUAUGCGUAC | 4092 | GCUUCUGUUCAUCGUGUAUGCGUAA |
| 1171 | 4093 | CUGUUCAUCGUGUAUGCGU | 4094 | CUGCUUCUGUUCAUCGUGUAUGCGA |
| 609 | 4095 | GAACUUCAUGGACAUAGAG | 4096 | UGGGGAGAACUUCAUGGACAUAGAA |
| 608 | 4097 | AGAACUUCAUGGACAUAGA | 4098 | GUGGGGAGAACUUCAUGGACAUAGA |
| 607 | 4099 | GAGAACUUCAUGGACAUAG | 4100 | UGUGGGGAGAACUUCAUGGACAUAA |
| 1322 | 4101 | ACAUUAGGUUAGCCAAGAC | 4102 | GCAUGGACAUUAGGUUAGCCAAGAA |
| 1321 | 4103 | GACAUUAGGUUAGCCAAGA | 4104 | CGCAUGGACAUUAGGUUAGCCAAGA |
| 1027 | 4105 | AUGUGGACCAUAGCCAUUG | 4106 | UGCCUGAUGUGGACCAUAGCCAUUA |
| 545 | 4107 | CAGAAUUUUACAACAAGUC | 4108 | ACAUUACAGAAUUUUACAACAAGUA |
| 532 | 4109 | CAGGUGAACAUUACAGAAU | 4110 | GCAGACCAGGUGAACAUUACAGAAA |
| 813 | 4111 | CAUUUUUGUCUACAGCUUC | 4112 | GAGUGUCAUUUUUGUCUACAGCUUA |
| 812 | 4113 | UCAUUUUUGUCUACAGCUU | 4114 | GGAGUGUCAUUUUUGUCUACAGCUA |
| 811 | 4115 | GUCAUUUUUGUCUACAGCU | 4116 | GGGAGUGUCAUUUUUGUCUACAGCA |
| 809 | 4117 | GUGUCAUUUUUGUCUACAG | 4118 | UGGGGAGUGUCAUUUUUGUCUACAA |
| 808 | 4119 | AGUGUCAUUUUUGUCUACA | 4120 | CUGGGGAGUGUCAUUUUUGUCUACA |
| 569 | 4121 | CGUCCUUCAAGGAGAAUGA | 4122 | CUCUCUCGUCCUUCAAGGAGAAUGA |
| 568 | 4123 | UCGUCCUUCAAGGAGAAUG | 4124 | UCUCUCUCGUCCUUCAAGGAGAAUA |
| 1444 | 4125 | UUUGCAUUCUGCAGUAUGC | 4126 | ACGGUGUUUGCAUUCUGCAGUAUGA |
| 1443 | 4127 | GUUUGCAUUCUGCAGUAUG | 4128 | GACGGUGUUUGCAUUCUGCAGUAUA |
| 1446 | 4129 | UGCAUUCUGCAGUAUGCUC | 4130 | GGUGUUUGCAUUCUGCAGUAUGCUA |
| 1445 | 4131 | UUGCAUUCUGCAGUAUGCU | 4132 | CGGUGUUUGCAUUCUGCAGUAUGCA |
| 1442 | 4133 | UGUUUGCAUUCUGCAGUAU | 4134 | AGACGGUGUUUGCAUUCUGCAGUAA |
| 1677 | 4135 | UGCCAAGGUAACCAUGUCU | 4136 | CAAGAUUGCCAAGGUAACCAUGUCA |
| 1676 | 4137 | UUGCCAAGGUAACCAUGUC | 4138 | UCAAGAUUGCCAAGGUAACCAUGUA |
| 1675 | 4139 | AUUGCCAAGGUAACCAUGU | 4140 | GUCAAGAUUGCCAAGGUAACCAUGA |
| 1603 | 4141 | CUGCACAAACACGCAAACA | 4142 | GACUGCCUGCACAAACACGCAAACA |
| 1110 | 4143 | UUUCCCACACAUUGAUGAA | 4144 | AGACAUUUCCCACACAUUGAUGAA |
| 1109 | 4145 | UUUUCCCACACAUUGAUGA | 4146 | CAGACAUUUCCCACACAUUGAUGA |
| 1108 | 4147 | AUUUUCCCACACAUUGAUG | 4148 | UCAGACAUUUCCCACACAUUGAUA |
| 1605 | 4149 | GCACAAACACGCAAACAAU | 4150 | CUGCCUGCACAAACACGCAAACAAA |
| 1604 | 4151 | UGCACAAACACGCAAACAA | 4152 | ACUGCCUGCACAAACACGCAAACAA |

TABLE 23-continued

CB1 sequences

| Ref Pos | SEQ ID NO | 19-mer Sense Seq | SEQ ID NO | 25-mer Sense Seq w/A @ 25 |
|---|---|---|---|---|
| 1671 | 4153 | CAAGAUUGCCAAGGUAACC | 4154 | CACGGUCAAGAUUGCCAAGGUAACA |
| 1670 | 4155 | UCAAGAUUGCCAAGGUAAC | 4156 | GCACGGUCAAGAUUGCCAAGGUAAA |
| 1669 | 4157 | GUCAAGAUUGCCAAGGUAA | 4158 | AGCACGGUCAAGAUUGCCAAGGUAA |
| 628 | 4159 | UGUUUCAUGGUCCUGAACC | 4160 | AUAGAGUGUUUCAUGGUCCUGAACA |
| 1115 | 4161 | CACACAUUGAUGAAACCUA | 4162 | UUUUCCCACACAUUGAUGAAACCUA |
| 1114 | 4163 | CCACACAUUGAUGAAACCU | 4164 | AUUUUCCCACACAUUGAUGAAACCA |
| 1113 | 4165 | CCCACACAUUGAUGAAACC | 4166 | CAUUUUCCCACACAUUGAUGAAACA |
| 1112 | 4167 | UCCCACACAUUGAUGAAAC | 4168 | ACAUUUUCCCACACAUUGAUGAAAA |
| 1111 | 4169 | UUCCCACACAUUGAUGAAA | 4170 | GACAUUUUCCCACACAUUGAUGAAA |
| 814 | 4171 | AUUUUGUCUACAGCUUCA | 4172 | AGUGCAUUUUUGUCUACAGCUUCA |
| 1659 | 4173 | CAAGAGCACGGUCAAGAUU | 4174 | CUGCAUCAAGAGCACGGUCAAGAUA |
| 1657 | 4175 | AUCAAGAGCACGGUCAAGA | 4176 | AGCUGCAUCAAGAGCACGGUCAAGA |
| 1167 | 4177 | GCUUCUGUUCAUCGUGUAU | 4178 | CGUACUGCUUCUGUUCAUCGUGUAA |
| 1166 | 4179 | UGCUUCUGUUCAUCGUGUA | 4180 | GCGUACUGCUUCUGUUCAUCGUGUA |
| 1668 | 4181 | GGUCAAGAUUGCCAAGGUA | 4182 | GAGCACGGUCAAGAUUGCCAAGGUA |
| 819 | 4183 | UGUCUACAGCUUCAUUGAC | 4184 | CAUUUUGUCUACAGCUUCAUUGAA |
| 818 | 4185 | UUGUCUACAGCUUCAUUGA | 4186 | UCAUUUUGUCUACAGCUUCAUUGA |
| 817 | 4187 | UUUGUCUACAGCUUCAUUG | 4188 | GUCAUUUUGUCUACAGCUUCAUUA |
| 816 | 4189 | UUUUGUCUACAGCUUCAUU | 4190 | UGUCAUUUUGUCUACAGCUUCAUA |
| 1543 | 4191 | UUUCCCUCUUGUGAAGGCA | 4192 | AGCAUGUUUCCCUCUUGUGAAGGCA |
| 1660 | 4193 | AAGAGCACGGUCAAGAUUG | 4194 | UGCAUCAAGAGCACGGUCAAGAUUA |
| 1030 | 4195 | UGGACCAUAGCCAUUGUGA | 4196 | CUGAUGUGGACCAUAGCCAUUGUGA |
| 531 | 4197 | CCAGGUGAACAUUACAGAA | 4198 | AGCAGACCAGGUGAACAUUACAGAA |
| 1259 | 4199 | UCAUCAUCCACACGUCUGA | 4200 | AGAGCAUCAUCAUCCACACGUCUGA |
| 1258 | 4201 | AUCAUCAUCCACACGUCUG | 4202 | AAGAGCAUCAUCAUCCACACGUCUA |

| Chemical Modification Key | |
|---|---|
| Chl | cholesterol with hydroxyprolinol linker |
| TEG-Chl | cholesterol with TEG linker |
| m | 2'Ome |

-continued

| Chemical Modification Key | |
|---|---|
| f | 2'fluoro |
| * | phosphorothioate linkage |
| . | phosphodiester linkage |

TABLE 24

Summary of CTGF Leads

| Generic Name | TEG ID | 2'F | Targeting site | Opt. lead sequence | Optimized lead sequence | Opt. lead 2'F | Opt. lead 2'OH | Priority |
|---|---|---|---|---|---|---|---|---|
| CTGF L1 | 21045 | 4 | 2295 | 21212 | mU.mU. G.mC. A.mC.mC.mU.mU.mU. mC.mU*mA*mA-chol P.mU.fU. A. G. A. mA. A. G. G.fU. G.fC. mA. mA* mA*fC*mA*mA* mG* G | 4 | 7(2) | 1 |

TABLE 24-continued

Summary of CTGF Leads

| Generic Name | TEG ID | 2'F | Targeting site | Opt. lead sequence | Optimized lead sequence | Opt. lead 2'F | Opt. lead 2'OH | Priority |
|---|---|---|---|---|---|---|---|---|
| | | | | 21214 | mU.mU. G.mC. A.mC.mC.mU.mU.mU.mC. mU*mA*mA-chol P.mU.fU. A. G. A. mA. A. G.fU. G.fC. A. A* A*fC* a*mA*mG*G | 4 | 12(2) | 3 |
| | | | | 21215 | mU.mU. G.mC. A. mC.mC.mU.mU.mU.mC. mU*mA*mA-chol P.mU.fU. A. G. A. mA. A. G. G.fU. G.fC. mA. A* mA*fC*A*mA*mG* G | 4 | 10(2) | 2 |
| CTGF L2 | 20393 | 5 | 2296 | 21204 | G.mC. A.mC.mC.mU.mU.mU.mC.mU. A*mG*mA-TEG-Chl P.mU.fC.fU.A.G.mA. A.mA.G.G.fU.G.mC*A*A*A*mC*A*U | 3 | 11(3) | 1 |
| | | | | 21205 | G.mC. A.mC.mC.mU.mU.mU.mC.mU. A*mG*mA-TEG-Chl P.mU.fC.fC.A.G.mA. A.mA.G.G.fU.G.mC*A*mA*A*mC*A*U | 3 | 10(3) | 3 |
| | | | | 21227 | G.mC. A.mC.mC.mU.mU.mU.mC.mU. A*mG*mA-TEG-Chl P.mU.fC.fU.A.G.mA. A.mA.G.G.fU.G.fC*mA*mA*mA*fC*mA*U | 5 | 7(3) | 2 |
| CTGF L3 | 20392 | 13 | 2275 | 21381 | G.mU. G. A. mC.mC. A. A. A. A. G*mU*mA-TEG-Chl P.mU.A.fC.fU. fU.fU.fU.G.G.fU.mC.A.mC*A*mC*mU*mC*mU*C. | 6 | 6(9) | 1 |
| | | | | 21383 | mG*mU*mG.mA.mC.mC.mA.mA.mA.mA. mG*mU*mA-TEG-Chl P.mU.A.fC.fU.fU.fU.fU. G.G.fU.mC.A.mC*A*mC*mU*mC*mU*C. | 6 | 6(0) | 2 |
| CTGF L4 | 17387 | 5 | 2299 | 21224 | mC.mC.mU.mU.mU.mC.mU. A. G.mU.mU* mG*mA-TEG-Chl P.mU.fC. A. A.fC.fU. A. G. A. mA. A. G. G*fU*mG*fC*mA*mA* A | 5 | 9(2) | 1 |

Table 24:
Lead 21212 corresponds to SEQ ID NOs 3445 and 3446;
lead 21214 corresponds to SEQ ID NOs 3449 and 3450 (an unmodified form of SEQ ID NO: 3450 corresponds to SEQ ID NO: 4205: UCAACUAGAAAGGUGCAAA);
lead 21215 corresponds to SEQ ID NOs 3451 and 3452 (an unmodified form of SEQ ID NO: 3452 corresponds to SEQ ID NO: 4204: UUAGAAAGGUGCAAACAAGG);
lead 21204 corresponds to SEQ ID NOs 3429 and 3430; lead 21205 corresponds to SEQ ID NOs 3431 and 3432;
lead 21227 corresponds to SEQ ID NOs 3475 and 3476;
lead 21381 corresponds to SEQ ID NOs 3493 and 3494;
lead 21383 corresponds to SEQ ID NOs 3497 and 3498; and
lead 21224 corresponds to SEQ ID NOs 3469 and 3470.

TABLE 25

Summary of PTGS2 Leads

| Generic Name | TEG ID | 2'F | Targeting site | Optimized lead sequence | Optimized lead sequence | Opt. lead 2'F | Opt. lead 2'OH | Priority |
|---|---|---|---|---|---|---|---|---|
| PTGS2 L1 | 20394 | 8 | 448 | 21228 | G. A.mU.mC. A.mC. A.mU.mU.mU. G*mA*mA-TEG-Chl P.mU.fU.fC.A.mA.A.fU. G.fU.G.A.fU.fC*fU*mG*mG*mA*fU* G | 8 | 6(5) | 1 |
| | | | | 21229 | G. A.mU.mC. A. mC. A. mU.mU.mU. G*mA*mA-TEG-Chl P.mU.fU.fC.A.A.A.fU.G. fU.G.A.mU.mC*mU*G*G*A*mU*G | 4 | 10(5) | 3 |
| | | | | 21230 | G. A.mU.mC. A. A.mU.mU.mU. G*mA*mA-TEG-Chl P.mU.fC.fC.A.A.A.fU.G. fU.G.A.fU.fC*fU*mG*mG*mA*fU* G | 8 | 7(5) | 2 |
| PTGS2 L2 | 20395 | 8 | 449 | 21293 | G. A.mU.mC. A. mC. A.mU.mU.mU. G. A*mU*mA-TEG-Chl P.mU. A.fU.fC. A. A. A.fU. G.fU. G. A.mU.mC*mU*mG*mG*mA* fU* G | 5 | 8(6) | 4 |
| | | | | 21394 | G. A.mU.mC. A. mC. A.mU.mU.mU. G. A*mU*mA-TEG-Chl P.mU. A.fU.fC. A. A. A. fU.G.fU. G. A.mU.fC*mU* G* G* A*fU* G | 6 | 11(6) | 3 |
| | | | | 21233 | G. A.mU.mC. A. mC. A. mU.mU.mU. G. A*mU*mA-TEG-Chl P.mU.A.fU.fC.A.A.A.fU.G.fU. G.A.fU.fC*fU*G*G*A*fU*G | 8 | 11(6) | 3 |

TABLE 25-continued

Summary of PTGS2 Leads

| Generic Name | TEG ID 2'F | Targeting site | Optimized lead sequence | Optimized lead sequence | Opt. lead 2'F | Opt. lead 2'OH | Priority |
|---|---|---|---|---|---|---|---|
| | | | 21234 | G. A.mU.mC. A.mC. A.mU.mU.mU. G. A*mU*mA-TEG-Chl P.mU.A.fU.fC.A.A.A.fU.G.fU. G.A.fU.fC*fU*mG*mG*mA*fU*G | 7 | 8(6) | 2 |

Table 25:
Lead 21228 corresponds to SEQ ID NOs 4309 and 4310;
lead 21229 corresponds to SEQ ID NOs 4311 and 4312;
lead 21230 corresponds to SEQ ID NOs 4313 and 4314;
lead 21293 corresponds to SEQ ID NOs 4315 and 4316;
lead 21394 corresponds to SEQ ID NOs 4317 and 4318;
lead 21233 corresponds to SEQ ID NOs 4319 and 501; and
lead 21234 corresponds to SEQ ID NOs 502 and 1059.

TABLE 26

Summary of hTGFB1 Leads

| Generic Name | Targeting site | Optimized lead sequence | Optimized lead sequence | Opt. lead 2'F | Opt. lead 2'OH | Priority |
|---|---|---|---|---|---|---|
| TGFb1 hL3 | 1244 | 21374 | mC*mA*mC.mA.mC.mA.mG.mC.mA.mU.mA*mU*mA-TEG-Chl P.mU.A.fU.A.fU.G.fC.fU.G.fU.G.fU.mG*fU*mA*fC*mU*fC*U | 9 | 6(0) | 1 |

Table 26:
lead 21374 corresponds to SEQ ID NOs 3793 and 3794.

TABLE 27

Summary of hTGFB2 Leads

| Generic Name | Targeting site | Optimized lead sequence | Optimized lead sequence | Opt. lead 2'F. | Opt. lead 2'OH | Priority |
|---|---|---|---|---|---|---|
| TGFb2 hL3 | 2081 | 21379 | mU*mC*mA.mU.mC.mA.mG.mU.mG.mU.mU*mA*mA-TEG-Chl P.mU.fU. A. A.fC. A.fC.fU. G. A.fU. G. A* A*fC*fC*mA*mA* G | 7 | 9(0) | 1 |
| | | | mU*mC*mA.mU.mC.mA.mG.mU.mG.mU.mU*mA*mA-TEG-Chl P.mU.fU. A. A.fC. A.fC.fU. G. A.fU. G.mA*mA*fC*fC*mA*mA* G | 7 | 7(0) | 2 |

Table 27:
lead 21379 corresponds to SEQ ID NOs 3637, 3638, 3639 and 3640.

Having thus described several aspects of at least one embodiment of this invention, it is to be appreciated various alterations, modifications, and improvements will readily occur to those skilled in the art. Such alterations, modifications, and improvements are intended to be part of this disclosure, and are intended to be within the spirit and scope of the invention. Accordingly, the foregoing description and drawings are by way of example only.

EQUIVALENTS

Those skilled in the art will recognize, or be able to ascertain using no more than routine experimentation, many equivalents to the specific embodiments of the invention described herein. Such equivalents are intended to be encompassed by the following claims.

All references, including patent documents, disclosed herein are incorporated by reference in their entirety. This application incorporates by reference the entire contents, including all the drawings and all parts of the specification (including sequence listing or amino acid/polynucleotide sequences) of PCT Publication No. WO2010/033247 (Application No. PCT/US2009/005247), filed on Sep. 22, 2009, and entitled "REDUCED SIZE SELF-DELIVERING RNAI COMPOUNDS" and PCT Publication No. WO2009/102427 (Application No. PCT/US2009/000852), filed on Feb. 11, 2009, and entitled, "MODIFIED RNAI POLYNUCLEOTIDES AND USES THEREOF."

SEQUENCE LISTING (4319 sequences)

SEQ ID NO: 1 - RNA, 13 nt, Artificial Sequence
  synthetic polynucleotide
gcuaaugguggaa

SEQ ID NO: 2 - RNA, 19 nt, Artificial Sequence
  synthetic polynucleotide
uuccaccauuagcacgcgg

SEQ ID NO: 3 - RNA, 13 nt, Artificial Sequence
  synthetic polynucleotide
ugaucgugcgcuc

SEQ ID NO: 4 - RNA, 19 nt, Artificial Sequence
  synthetic polynucleotide
gagcgcacgaucauguugg

SEQ ID NO: 5 - RNA, 13 nt, Artificial Sequence
  synthetic polynucleotide
caauuccuggcga

SEQ ID NO: 6 - RNA, 19 nt, Artificial Sequence
  synthetic polynucleotide
ucgccaggaauuguugcug

SEQ ID NO: 7 - RNA, 13 nt, Artificial Sequence
  synthetic polynucleotide
aguggauccacga

SEQ ID NO: 8 - RNA, 19 nt, Artificial Sequence
  synthetic polynucleotide
ucguggauccacuuccagc

SEQ ID NO: 9 - RNA, 13 nt, Artificial Sequence
  synthetic polynucleotide
uacagcaaggucc

SEQ ID NO: 10 - RNA, 19 nt, Artificial Sequence
  synthetic polynucleotide
ggaccuugcuguacugcgu

SEQ ID NO: 11 - RNA, 13 nt, Artificial Sequence
  synthetic polynucleotide
aacaugaucgugc

SEQ ID NO: 12 - RNA, 19 nt, Artificial Sequence
  synthetic polynucleotide
gcacgaucauguuggacag

SEQ ID NO: 13 - RNA, 13 nt, Artificial Sequence
  synthetic polynucleotide
acaugaucgugcg

SEQ ID NO: 14 - RNA, 19 nt, Artificial Sequence
  synthetic polynucleotide
cgcacgaucauguuggaca

SEQ ID NO: 15 - RNA, 13 nt, Artificial Sequence
  synthetic polynucleotide
cagcaagguccug

SEQ ID NO: 16 - RNA, 19 nt, Artificial Sequence
  synthetic polynucleotide
caggaccuugcuguacugc

SEQ ID NO: 17 - RNA, 13 nt, Artificial Sequence
  synthetic polynucleotide
ccaacaugaucgu

SEQ ID NO: 18 - RNA, 19 nt, Artificial Sequence
  synthetic polynucleotide
acgaucauguuggacagcu

SEQ ID NO: 19 - RNA, 13 nt, Artificial Sequence
  synthetic polynucleotide
agcggaagcgcau

SEQ ID NO: 20 - RNA, 19 nt, Artificial Sequence
  synthetic polynucleotide
augcgcuuccgcuucacca

SEQ ID NO: 21 - RNA, 13 nt, Artificial Sequence
  synthetic polynucleotide
gcaucgaggccau

SEQ ID NO: 22 - RNA, 19 nt, Artificial Sequence
  synthetic polynucleotide
auggccucgaugcgcuucc

SEQ ID NO: 23 - RNA, 13 nt, Artificial Sequence
  synthetic polynucleotide
gacuaucgacaug

SEQ ID NO: 24 - RNA, 19 nt, Artificial Sequence
  synthetic polynucleotide
caugucgauagucuugcag

SEQ ID NO: 25 - RNA, 13 nt, Artificial Sequence
  synthetic polynucleotide
accugcaagacua

SEQ ID NO: 26 - RNA, 19 nt, Artificial Sequence
  synthetic polynucleotide
uagucuugcagguggauag

SEQ ID NO: 27 - RNA, 13 nt, Artificial Sequence
  synthetic polynucleotide
gcuccacggagaa

SEQ ID NO: 28 - RNA, 19 nt, Artificial Sequence
  synthetic polynucleotide
uucuccguggagcugaagc

SEQ ID NO: 29 - RNA, 13 nt, Artificial Sequence
  synthetic polynucleotide
ggcucuccuucga

SEQ ID NO: 30 - RNA, 19 nt, Artificial Sequence
  synthetic polynucleotide
ucgaaggagagccauucgc

SEQ ID NO: 31 - RNA, 13 nt, Artificial Sequence
  synthetic polynucleotide
gacaggaaccugg

SEQ ID NO: 32 - RNA, 19 nt, Artificial Sequence
  synthetic polynucleotide
ccagguuccugucuuuaug

SEQ ID NO: 33 - RNA, 13 nt, Artificial Sequence
  synthetic polynucleotide
ccaaggagguuua

SEQ ID NO: 34 - RNA, 19 nt, Artificial Sequence
  synthetic polynucleotide
uaaaccuccuuggcguagu

SEQ ID NO: 35 - RNA, 13 nt, Artificial Sequence
  synthetic polynucleotide
auuuccaucuaca

SEQ ID NO: 36 - RNA, 19 nt, Artificial Sequence
  synthetic polynucleotide
uguagauggaaaucaccuc

SEQ ID NO: 37 - RNA, 13 nt, Artificial Sequence
  synthetic polynucleotide
uccaucuacaaca

SEQ ID NO: 38 - RNA, 19 nt, Artificial Sequence
  synthetic polynucleotide
uguuguagauggaaaucac

SEQ ID NO: 39 - RNA, 13 nt, Artificial Sequence
  synthetic polynucleotide
uuuccaucuacaa

SEQ ID NO: 40 - RNA, 19 nt, Artificial Sequence
  synthetic polynucleotide
uuguagauggaaaucaccu

SEQ ID NO: 41 - RNA, 13 nt, Artificial Sequence
  synthetic polynucleotide
cgccaaggagguu

SEQ ID NO: 42 - RNA, 19 nt, Artificial Sequence
  synthetic polynucleotide
aaccuccuuggcguaguac

SEQ ID NO: 43 - RNA, 13 nt, Artificial Sequence
  synthetic polynucleotide
guggugaucagaa

SEQ ID NO: 44 - RNA, 19 nt, Artificial Sequence
  synthetic polynucleotide
uucugaucaccacugguau

SEQ ID NO: 45 - RNA, 13 nt, Artificial Sequence
  synthetic polynucleotide
cuccugcuaaugu

SEQ ID NO: 46 - RNA, 19 nt, Artificial Sequence
  synthetic polynucleotide
acauuagcaggagaugugg

SEQ ID NO: 47 - RNA, 13 nt, Artificial Sequence
  synthetic polynucleotide
accuccacauaua

SEQ ID NO: 48 - RNA, 19 nt, Artificial Sequence
  synthetic polynucleotide
uauauguggaggugccauc

SEQ ID NO: 49 - RNA, 13 nt, Artificial Sequence
  synthetic polynucleotide
aaguccacuagga

SEQ ID NO: 50 - RNA, 19 nt, Artificial Sequence
  synthetic polynucleotide
uccuaguggacuuuauagu

SEQ ID NO: 51 - RNA, 13 nt, Artificial Sequence
  synthetic polynucleotide
uggugaucagaaa

SEQ ID NO: 52 - RNA, 19 nt, Artificial Sequence
  synthetic polynucleotide
uuucugaucaccacuggua

SEQ ID NO: 53 - RNA, 13 nt, Artificial Sequence
  synthetic polynucleotide
aguccacuaggaa

SEQ ID NO: 54 - RNA, 19 nt, Artificial Sequence
  synthetic polynucleotide
uuccuaguggacuuuauag

SEQ ID NO: 55 - RNA, 13 nt, Artificial Sequence
  synthetic polynucleotide
acgccaaggaggu

SEQ ID NO: 56 - RNA, 19 nt, Artificial Sequence
  synthetic polynucleotide
accuccuuggcguaguacu

SEQ ID NO: 57 - RNA, 13 nt, Artificial Sequence
  synthetic polynucleotide
cacauuugauuga

SEQ ID NO: 58 - RNA, 19 nt, Artificial Sequence
  synthetic polynucleotide
ucaaucaaaugugaucugg

SEQ ID NO: 59 - RNA, 13 nt, Artificial Sequence
  synthetic polynucleotide
cacugccucaauu

SEQ ID NO: 60 - RNA, 19 nt, Artificial Sequence
  synthetic polynucleotide
aauugaggcaguguugaug

SEQ ID NO: 61 - RNA, 13 nt, Artificial Sequence
  synthetic polynucleotide
aaauaccagucuu

SEQ ID NO: 62 - RNA, 19 nt, Artificial Sequence
  synthetic polynucleotide
aagacugguauuucaucug

SEQ ID NO: 63 - RNA, 13 nt, Artificial Sequence
  synthetic polynucleotide
cauuugauugaca

SEQ ID NO: 64 - RNA, 19 nt, Artificial Sequence
  synthetic polynucleotide
ugucaaucaaaugugaucu

SEQ ID NO: 65 - RNA, 25 nt, Artificial Sequence
  synthetic polynucleotide
ccuggcgcucagccauacagcaaaa

SEQ ID NO: 66 - RNA, 25 nt, Artificial Sequence
  synthetic polynucleotide
cuggcgcucagccauacagcaaaua

SEQ ID NO: 67 - RNA, 25 nt, Artificial Sequence
  synthetic polynucleotide
uggcgcucagccauacagcaaauca

SEQ ID NO: 68 - RNA, 25 nt, Artificial Sequence
  synthetic polynucleotide
gcgcucagccauacagcaaauccua

SEQ ID NO: 69 - RNA, 25 nt, Artificial Sequence
  synthetic polynucleotide
gcucagccauacagcaaauccuuga

SEQ ID NO: 70 - RNA, 25 nt, Artificial Sequence
  synthetic polynucleotide
cucagccauacagcaaauccuugca

SEQ ID NO: 71 - RNA, 25 nt, Artificial Sequence
  synthetic polynucleotide
ucagccauacagcaaauccuugcua

SEQ ID NO: 72 - RNA, 25 nt, Artificial Sequence
  synthetic polynucleotide
agccauacagcaaauccuugcugua

SEQ ID NO: 73 - RNA, 25 nt, Artificial Sequence
  synthetic polynucleotide
gccauacagcaaauccuugcuguua

SEQ ID NO: 74 - RNA, 25 nt, Artificial Sequence
  synthetic polynucleotide
ccauacagcaaauccuugcuguuca

SEQ ID NO: 75 - RNA, 25 nt, Artificial Sequence
  synthetic polynucleotide
ccacccaugucaaaaccgaggugua

SEQ ID NO: 76 - RNA, 25 nt, Artificial Sequence
  synthetic polynucleotide
agugugggauuugaccaguauaaga

SEQ ID NO: 77 - RNA, 25 nt, Artificial Sequence
  synthetic polynucleotide
gugugggauuugaccaguauaagua

SEQ ID NO: 78 - RNA, 25 nt, Artificial Sequence
  synthetic polynucleotide
ugugggauuugaccaguauaaguga

SEQ ID NO: 79 - RNA, 25 nt, Artificial Sequence
  synthetic polynucleotide
uuugaccaguauaagugcgauugua

SEQ ID NO: 80 - RNA, 25 nt, Artificial Sequence
  synthetic polynucleotide
ggauucuauggagaaaacugcucaa

SEQ ID NO: 81 - RNA, 25 nt, Artificial Sequence
  synthetic polynucleotide
uauuucugaaacccacuccaaacaa

SEQ ID NO: 82 - RNA, 25 nt, Artificial Sequence
  synthetic polynucleotide
auuucugaaacccacuccaaacaca

SEQ ID NO: 83 - RNA, 25 nt, Artificial Sequence
  synthetic polynucleotide
uuucugaaacccacuccaaacacaa

SEQ ID NO: 84 - RNA, 25 nt, Artificial Sequence
  synthetic polynucleotide
uucugaaacccacuccaaacacaga

SEQ ID NO: 85 - RNA, 25 nt, Artificial Sequence
  synthetic polynucleotide
aaacccacuccaaacacagugcaca

SEQ ID NO: 86 - RNA, 25 nt, Artificial Sequence
  synthetic polynucleotide
acccacuccaaacacagugcacuaa

SEQ ID NO: 87 - RNA, 25 nt, Artificial Sequence
  synthetic polynucleotide
ccacuccaaacacagugcacuacaa

SEQ ID NO: 88 - RNA, 25 nt, Artificial Sequence
  synthetic polynucleotide
cacuccaaacacagugcacuacaua

SEQ ID NO: 89 - RNA, 25 nt, Artificial Sequence
  synthetic polynucleotide
uuuggaacguugugaauaacauuca

SEQ ID NO: 90 - RNA, 25 nt, Artificial Sequence
  synthetic polynucleotide
ugaauaacauucccuuccuucgaaa

SEQ ID NO: 91 - RNA, 25 nt, Artificial Sequence
  synthetic polynucleotide
gaauaacauucccuuccuucgaaaa

SEQ ID NO: 92 - RNA, 25 nt, Artificial Sequence
  synthetic polynucleotide
aauaacauucccuuccuucgaaaua

SEQ ID NO: 93 - RNA, 25 nt, Artificial Sequence
  synthetic polynucleotide
auuaugaguuauguguugacaucca

SEQ ID NO: 94 - RNA, 25 nt, Artificial Sequence
  synthetic polynucleotide
uaugaguuauguguugacauccaga

SEQ ID NO: 95 - RNA, 25 nt, Artificial Sequence
  synthetic polynucleotide
ugaguuauguguugacauccagaua

SEQ ID NO: 96 - RNA, 25 nt, Artificial Sequence
  synthetic polynucleotide
gaguuauguguugacauccagauca

SEQ ID NO: 97 - RNA, 25 nt, Artificial Sequence
  synthetic polynucleotide
aguuauguguugacauccagaucaa

SEQ ID NO: 98 - RNA, 25 nt, Artificial Sequence
  synthetic polynucleotide
guuauguguugacauccagaucaca

SEQ ID NO: 99 - RNA, 25 nt, Artificial Sequence
  synthetic polynucleotide
uuauguguugacauccagaucacaa

SEQ ID NO: 100 - RNA, 25 nt, Artificial Sequence
  synthetic polynucleotide
uauguguugacauccagaucacaua

SEQ ID NO: 101 - RNA, 25 nt, Artificial Sequence
  synthetic polynucleotide
auguguugacauccagaucacauua

SEQ ID NO: 102 - RNA, 25 nt, Artificial Sequence
  synthetic polynucleotide
uguguugacauccagaucacauuua

SEQ ID NO: 103 - RNA, 25 nt, Artificial Sequence
  synthetic polynucleotide
uguugacauccagaucacauuugaa

SEQ ID NO: 104 - RNA, 25 nt, Artificial Sequence
  synthetic polynucleotide
guugacauccagaucacauuugaua

SEQ ID NO: 105 - RNA, 25 nt, Artificial Sequence
  synthetic polynucleotide
uugacauccagaucacauuugauua

SEQ ID NO: 106 - RNA, 25 nt, Artificial Sequence
  synthetic polynucleotide
gacauccagaucacauuugauugaa

SEQ ID NO: 107 - RNA, 25 nt, Artificial Sequence
  synthetic polynucleotide
cauccagaucacauuugauugacaa

SEQ ID NO: 108 - RNA, 25 nt, Artificial Sequence
  synthetic polynucleotide
auccagaucacauuugauugacaga

SEQ ID NO: 109 - RNA, 25 nt, Artificial Sequence
  synthetic polynucleotide
uccagaucacauuugauugacagua

SEQ ID NO: 110 - RNA, 25 nt, Artificial Sequence
  synthetic polynucleotide
ccagaucacauuugauugacaguca

SEQ ID NO: 111 - RNA, 25 nt, Artificial Sequence
  synthetic polynucleotide
gaucacauuugauugacaguccaca

SEQ ID NO: 112 - RNA, 25 nt, Artificial Sequence
  synthetic polynucleotide
aucacauuugauugacaguccacca

SEQ ID NO: 113 - RNA, 25 nt, Artificial Sequence
  synthetic polynucleotide
ucacauuugauugacaguccaccaa

SEQ ID NO: 114 - RNA, 25 nt, Artificial Sequence
  synthetic polynucleotide
cacauuugauugacaguccaccaaa

SEQ ID NO: 115 - RNA, 25 nt, Artificial Sequence
  synthetic polynucleotide
acauuugauugacaguccaccaaca

SEQ ID NO: 116 - RNA, 25 nt, Artificial Sequence
  synthetic polynucleotide
cauuugauugacaguccaccaacua

SEQ ID NO: 117 - RNA, 25 nt, Artificial Sequence
  synthetic polynucleotide
uuugauugacaguccaccaacuuaa

SEQ ID NO: 118 - RNA, 25 nt, Artificial Sequence
  synthetic polynucleotide
uugauugacaguccaccaacuuaca

SEQ ID NO: 119 - RNA, 25 nt, Artificial Sequence
  synthetic polynucleotide
ugauugacaguccaccaacuuacaa

SEQ ID NO: 120 - RNA, 25 nt, Artificial Sequence
  synthetic polynucleotide
gauugacaguccaccaacuuacaaa

SEQ ID NO: 121 - RNA, 25 nt, Artificial Sequence
  synthetic polynucleotide
auugacaguccaccaacuuacaaua

SEQ ID NO: 122 - RNA, 25 nt, Artificial Sequence
  synthetic polynucleotide
uugacaguccaccaacuuacaauga

SEQ ID NO: 123 - RNA, 25 nt, Artificial Sequence
  synthetic polynucleotide
ugacaguccaccaacuuacaaugca

SEQ ID NO: 124 - RNA, 25 nt, Artificial Sequence
  synthetic polynucleotide
uccaccaacuuacaaugcugacuaa

SEQ ID NO: 125 - RNA, 25 nt, Artificial Sequence
  synthetic polynucleotide
acuuacaaugcugacuauggcuaca

SEQ ID NO: 126 - RNA, 25 nt, Artificial Sequence
  synthetic polynucleotide
uuacaaugcugacuauggcuacaaa

SEQ ID NO: 127 - RNA, 25 nt, Artificial Sequence
  synthetic polynucleotide
gggaagccuucucuaaccucuccua

SEQ ID NO: 128 - RNA, 25 nt, Artificial Sequence
  synthetic polynucleotide
ggaagccuucucuaaccucuccuaa

SEQ ID NO: 129 - RNA, 25 nt, Artificial Sequence
  synthetic polynucleotide
gaagccuucucuaaccucuccuaua

SEQ ID NO: 130 - RNA, 25 nt, Artificial Sequence
  synthetic polynucleotide
aagccuucucuaaccucuccuauua

SEQ ID NO: 131 - RNA, 25 nt, Artificial Sequence
  synthetic polynucleotide
cuucucuaaccucuccuauuauaca

SEQ ID NO: 132 - RNA, 25 nt, Artificial Sequence
  synthetic polynucleotide
uucucuaaccucuccuauuauacua

SEQ ID NO: 133 - RNA, 25 nt, Artificial Sequence
  synthetic polynucleotide
ucucuaaccucuccuauuauacuaa

SEQ ID NO: 134 - RNA, 25 nt, Artificial Sequence
  synthetic polynucleotide
guaaaaagcagcuuccugauucaaa

SEQ ID NO: 135 - RNA, 25 nt, Artificial Sequence
  synthetic polynucleotide
uaaaaagcagcuuccugauucaaaa

SEQ ID NO: 136 - RNA, 25 nt, Artificial Sequence
  synthetic polynucleotide
aagcagcuuccugauucaaaugaga

SEQ ID NO: 137 - RNA, 25 nt, Artificial Sequence
  synthetic polynucleotide
ccugauucaaaugagauuguggaaa

SEQ ID NO: 138 - RNA, 25 nt, Artificial Sequence
  synthetic polynucleotide
cugauucaaaugagauuguggaaaa

SEQ ID NO: 139 - RNA, 25 nt, Artificial Sequence
  synthetic polynucleotide
gaaaaauugcuucuaagaagaaaga

SEQ ID NO: 140 - RNA, 25 nt, Artificial Sequence
  synthetic polynucleotide
aaaaauugcuucuaagaagaaagua

SEQ ID NO: 141 - RNA, 25 nt, Artificial Sequence
  synthetic polynucleotide
aaaauugcuucuaagaagaaaguua

SEQ ID NO: 142 - RNA, 25 nt, Artificial Sequence
  synthetic polynucleotide
aaauugcuucuaagaagaaaguuca

SEQ ID NO: 143 - RNA, 25 nt, Artificial Sequence
  synthetic polynucleotide
ggcucaaacaugauguuugcauuca

SEQ ID NO: 144 - RNA, 25 nt, Artificial Sequence
  synthetic polynucleotide
gcucaaacaugauguuugcauucua

SEQ ID NO: 145 - RNA, 25 nt, Artificial Sequence
  synthetic polynucleotide
cucaaacaugauguuugcauucuua

SEQ ID NO: 146 - RNA, 25 nt, Artificial Sequence
  synthetic polynucleotide
caaacaugauguuugcauucuuuga

SEQ ID NO: 147 - RNA, 25 nt, Artificial Sequence
  synthetic polynucleotide
aaacaugauguuugcauucuuugca

SEQ ID NO: 148 - RNA, 25 nt, Artificial Sequence
  synthetic polynucleotide
ucaguuuuucaagacagaucauaaa

SEQ ID NO: 149 - RNA, 25 nt, Artificial Sequence
  synthetic polynucleotide
caguuuuucaagacagaucauaaga

SEQ ID NO: 150 - RNA, 25 nt, Artificial Sequence
  synthetic polynucleotide
aguuuuucaagacagaucauaagca

SEQ ID NO: 151 - RNA, 25 nt, Artificial Sequence
  synthetic polynucleotide
guuuuucaagacagaucauaagcga

SEQ ID NO: 152 - RNA, 25 nt, Artificial Sequence
  synthetic polynucleotide
uuuuucaagacagaucauaagcgaa

SEQ ID NO: 153 - RNA, 25 nt, Artificial Sequence
  synthetic polynucleotide
ccaugggguggacuuaaaucauaua

SEQ ID NO: 154 - RNA, 25 nt, Artificial Sequence
  synthetic polynucleotide
acuuaaaucauauuuacggugaaaa

SEQ ID NO: 155 - RNA, 25 nt, Artificial Sequence
  synthetic polynucleotide
cuuaaaucauauuuacggugaaaca

SEQ ID NO: 156 - RNA, 25 nt, Artificial Sequence
  synthetic polynucleotide
uuaaaucauauuuacggugaaacua

SEQ ID NO: 157 - RNA, 25 nt, Artificial Sequence
  synthetic polynucleotide
uaaaucauauuuacggugaaacuca

SEQ ID NO: 158 - RNA, 25 nt, Artificial Sequence
  synthetic polynucleotide
aaucauauuuacggugaaacucuga

SEQ ID NO: 159 - RNA, 25 nt, Artificial Sequence
  synthetic polynucleotide
aucauauuuacggugaaacucugga

SEQ ID NO: 160 - RNA, 25 nt, Artificial Sequence
  synthetic polynucleotide
uuuacggugaaacucuggcuagaca

SEQ ID NO: 161 - RNA, 25 nt, Artificial Sequence
  synthetic polynucleotide
agacagcguaaacugcgccuuuuca

SEQ ID NO: 162 - RNA, 25 nt, Artificial Sequence
  synthetic polynucleotide
gacagcguaaacugcgccuuuucaa

SEQ ID NO: 163 - RNA, 25 nt, Artificial Sequence
  synthetic polynucleotide
acagcguaaacugcgccuuuucaaa

SEQ ID NO: 164 - RNA, 25 nt, Artificial Sequence
  synthetic polynucleotide
cagcguaaacugcgccuuuucaaga

SEQ ID NO: 165 - RNA, 25 nt, Artificial Sequence
  synthetic polynucleotide
agcguaaacugcgccuuuucaagga

SEQ ID NO: 166 - RNA, 25 nt, Artificial Sequence
  synthetic polynucleotide
aaacugcgccuuuucaaggauggaa

SEQ ID NO: 167 - RNA, 25 nt, Artificial Sequence
  synthetic polynucleotide
acugcgccuuuucaaggauggaaaa

SEQ ID NO: 168 - RNA, 25 nt, Artificial Sequence
  synthetic polynucleotide
uaucagauaauugauggagagauga

SEQ ID NO: 169 - RNA, 25 nt, Artificial Sequence
  synthetic polynucleotide
aucagauaauugauggagagaugua

SEQ ID NO: 170 - RNA, 25 nt, Artificial Sequence
  synthetic polynucleotide
ucagauaauugauggagagauguaa

SEQ ID NO: 171 - RNA, 25 nt, Artificial Sequence
  synthetic polynucleotide
cagauaauugauggagagauguaua

SEQ ID NO: 172 - RNA, 25 nt, Artificial Sequence
  synthetic polynucleotide
agauaauugauggagagauguauca

SEQ ID NO: 173 - RNA, 25 nt, Artificial Sequence
  synthetic polynucleotide
gauaauugauggagagauguaucca

SEQ ID NO: 174 - RNA, 25 nt, Artificial Sequence
  synthetic polynucleotide
auaauugauggagagauguauccua

SEQ ID NO: 175 - RNA, 25 nt, Artificial Sequence
  synthetic polynucleotide
agauguauccucccacagucaaaga

SEQ ID NO: 176 - RNA, 25 nt, Artificial Sequence
  synthetic polynucleotide
gauguauccucccacagucaaagaa

SEQ ID NO: 177 - RNA, 25 nt, Artificial Sequence
  synthetic polynucleotide
auguauccucccacagucaaagaua

SEQ ID NO: 178 - RNA, 25 nt, Artificial Sequence
  synthetic polynucleotide
uguauccucccacagucaaagauaa

SEQ ID NO: 179 - RNA, 25 nt, Artificial Sequence
  synthetic polynucleotide
guauccucccacagucaaagauaca

SEQ ID NO: 180 - RNA, 25 nt, Artificial Sequence
  synthetic polynucleotide
uauccucccacagucaaagauacua

SEQ ID NO: 181 - RNA, 25 nt, Artificial Sequence
  synthetic polynucleotide
uccucccacagucaaagauacucaa

SEQ ID NO: 182 - RNA, 25 nt, Artificial Sequence
  synthetic polynucleotide
ccucccacagucaaagauacucaga

SEQ ID NO: 183 - RNA, 25 nt, Artificial Sequence
  synthetic polynucleotide
cucccacagucaaagauacucagga

SEQ ID NO: 184 - RNA, 25 nt, Artificial Sequence
  synthetic polynucleotide
cccacagucaaagauacucaggcaa

SEQ ID NO: 185 - RNA, 25 nt, Artificial Sequence
  synthetic polynucleotide
aagauacucaggcagagaugaucua

SEQ ID NO: 186 - RNA, 25 nt, Artificial Sequence
  synthetic polynucleotide
agucccugagcaucuacgguuugca

SEQ ID NO: 187 - RNA, 25 nt, Artificial Sequence
  synthetic polynucleotide
ucuggugccuggucugaugauguaa

SEQ ID NO: 188 - RNA, 25 nt, Artificial Sequence
  synthetic polynucleotide
cuggugccuggucugaugauguaua

SEQ ID NO: 189 - RNA, 25 nt, Artificial Sequence
  synthetic polynucleotide
uggugccuggucugaugauguauga

SEQ ID NO: 190 - RNA, 25 nt, Artificial Sequence
  synthetic polynucleotide
ggugccuggucugaugauguaugca

SEQ ID NO: 191 - RNA, 25 nt, Artificial Sequence
  synthetic polynucleotide
gugccuggucugaugauguaugcca

SEQ ID NO: 192 - RNA, 25 nt, Artificial Sequence
  synthetic polynucleotide
ugccuggucugaugauguaugccaa

SEQ ID NO: 193 - RNA, 25 nt, Artificial Sequence
  synthetic polynucleotide
gccuggucugaugauguaugccaca

SEQ ID NO: 194 - RNA, 25 nt, Artificial Sequence
  synthetic polynucleotide
gcugcgggaacacaacagaguauga

SEQ ID NO: 195 - RNA, 25 nt, Artificial Sequence
  synthetic polynucleotide
gcgggaacacaacagaguaugcgaa

SEQ ID NO: 196 - RNA, 25 nt, Artificial Sequence
  synthetic polynucleotide
ugcgaugugcuuaaacaggagcaua

SEQ ID NO: 197 - RNA, 25 nt, Artificial Sequence
  synthetic polynucleotide
gcgaugugcuuaaacaggagcauca

SEQ ID NO: 198 - RNA, 25 nt, Artificial Sequence
  synthetic polynucleotide
cgaugugcuuaaacaggagcaucca

SEQ ID NO: 199 - RNA, 25 nt, Artificial Sequence
  synthetic polynucleotide
augugcuuaaacaggagcauccuga

SEQ ID NO: 200 - RNA, 25 nt, Artificial Sequence
  synthetic polynucleotide
ugugcuuaaacaggagcauccugaa

SEQ ID NO: 201 - RNA, 25 nt, Artificial Sequence
  synthetic polynucleotide
gugcuuaaacaggagcauccugaaa

SEQ ID NO: 202 - RNA, 25 nt, Artificial Sequence
  synthetic polynucleotide
ugcuuaaacaggagcauccugaaua

SEQ ID NO: 203 - RNA, 25 nt, Artificial Sequence
  synthetic polynucleotide
uguuccagacaagcaggcuaauaca

SEQ ID NO: 204 - RNA, 25 nt, Artificial Sequence
  synthetic polynucleotide
caagcaggcuaauacugauaggaga

SEQ ID NO: 205 - RNA, 25 nt, Artificial Sequence
  synthetic polynucleotide
agcaggcuaauacugauaggagaga

SEQ ID NO: 206 - RNA, 25 nt, Artificial Sequence
  synthetic polynucleotide
gcaggcuaauacugauaggagagaa

SEQ ID NO: 207 - RNA, 25 nt, Artificial Sequence
  synthetic polynucleotide
uaagauugugauugaagauuaugua

SEQ ID NO: 208 - RNA, 25 nt, Artificial Sequence
  synthetic polynucleotide
aagauugugauugaagauuauguga

SEQ ID NO: 209 - RNA, 25 nt, Artificial Sequence
  synthetic polynucleotide
agauugugauugaagauuaugugca

SEQ ID NO: 210 - RNA, 25 nt, Artificial Sequence
  synthetic polynucleotide
gauugugauugaagauuaugugcaa

SEQ ID NO: 211 - RNA, 25 nt, Artificial Sequence
  synthetic polynucleotide
auugugauugaagauuaugugcaaa

SEQ ID NO: 212 - RNA, 25 nt, Artificial Sequence
  synthetic polynucleotide
uugugauugaagauuaugugcaaca

SEQ ID NO: 213 - RNA, 25 nt, Artificial Sequence
  synthetic polynucleotide
gugauugaagauuaugugcaacaca

SEQ ID NO: 214 - RNA, 25 nt, Artificial Sequence
  synthetic polynucleotide
ugauugaagauuaugugcaacacua

SEQ ID NO: 215 - RNA, 25 nt, Artificial Sequence
  synthetic polynucleotide
auugaagauuaugugcaacacuuga

SEQ ID NO: 216 - RNA, 25 nt, Artificial Sequence
  synthetic polynucleotide
ugaagauuaugugcaacacuugaga

SEQ ID NO: 217 - RNA, 25 nt, Artificial Sequence
  synthetic polynucleotide
aagauuaugugcaacacuugaguga

SEQ ID NO: 218 - RNA, 25 nt, Artificial Sequence
  synthetic polynucleotide
ugugcaacacuugaguggcuaucaa

SEQ ID NO: 219 - RNA, 25 nt, Artificial Sequence
  synthetic polynucleotide
caacacuugaguggcuaucacuuca

SEQ ID NO: 220 - RNA, 25 nt, Artificial Sequence
  synthetic polynucleotide
aaauuugacccagaacuacuuuuca

SEQ ID NO: 221 - RNA, 25 nt, Artificial Sequence
  synthetic polynucleotide
aauuugacccagaacuacuuuucaa

SEQ ID NO: 222 - RNA, 25 nt, Artificial Sequence
  synthetic polynucleotide
auuugacccagaacuacuuuucaaa

SEQ ID NO: 223 - RNA, 25 nt, Artificial Sequence
  synthetic polynucleotide
uucaacaaacaauuccaguaccaaa

SEQ ID NO: 224 - RNA, 25 nt, Artificial Sequence
  synthetic polynucleotide
auuccaguaccaaaaucguauugca

SEQ ID NO: 225 - RNA, 25 nt, Artificial Sequence
  synthetic polynucleotide
guaccaaaaucguauugcugcugaa

SEQ ID NO: 226 - RNA, 25 nt, Artificial Sequence
  synthetic polynucleotide
uucugccugacaccuuucaaauuca

SEQ ID NO: 227 - RNA, 25 nt, Artificial Sequence
  synthetic polynucleotide
caccuuucaaauucaugaccagaaa

SEQ ID NO: 228 - RNA, 25 nt, Artificial Sequence
  synthetic polynucleotide
uuucaaauucaugaccagaaauaca

SEQ ID NO: 229 - RNA, 25 nt, Artificial Sequence
  synthetic polynucleotide
aauucaugaccagaaauacaacuaa

SEQ ID NO: 230 - RNA, 25 nt, Artificial Sequence
  synthetic polynucleotide
acaacaacucuauauugcuggaaca

SEQ ID NO: 231 - RNA, 25 nt, Artificial Sequence
  synthetic polynucleotide
uggaauuacccaguuuguugaauca

SEQ ID NO: 232 - RNA, 25 nt, Artificial Sequence
  synthetic polynucleotide
auuacccaguuuguugaaucauuca

SEQ ID NO: 233 - RNA, 25 nt, Artificial Sequence
  synthetic polynucleotide
uuacccaguuuguugaaucauucaa

SEQ ID NO: 234 - RNA, 25 nt, Artificial Sequence
  synthetic polynucleotide
acccaguuuguugaaucauucacca

SEQ ID NO: 235 - RNA, 25 nt, Artificial Sequence
  synthetic polynucleotide
cccaguuuguugaaucauucaccaa

SEQ ID NO: 236 - RNA, 25 nt, Artificial Sequence
  synthetic polynucleotide
ccaguuuguugaaucauucaccaga

SEQ ID NO: 237 - RNA, 25 nt, Artificial Sequence
  synthetic polynucleotide
uuuguugaaucauucaccaggcaaa

SEQ ID NO: 238 - RNA, 25 nt, Artificial Sequence
  synthetic polynucleotide
agagcaggcagaugaaauaccagua

SEQ ID NO: 239 - RNA, 25 nt, Artificial Sequence
  synthetic polynucleotide
gagcaggcagaugaaauaccaguca

SEQ ID NO: 240 - RNA, 25 nt, Artificial Sequence
  synthetic polynucleotide
gcaggcagaugaaauaccagucuua

SEQ ID NO: 241 - RNA, 25 nt, Artificial Sequence
  synthetic polynucleotide
caggcagaugaaauaccagucuuua

SEQ ID NO: 242 - RNA, 25 nt, Artificial Sequence
  synthetic polynucleotide
gaugaaauaccagucuuuuaaugaa

SEQ ID NO: 243 - RNA, 25 nt, Artificial Sequence
  synthetic polynucleotide
augaaauaccagucuuuuaaugaga

SEQ ID NO: 244 - RNA, 25 nt, Artificial Sequence
  synthetic polynucleotide
ugaaauaccagucuuuuaaugagua

SEQ ID NO: 245 - RNA, 25 nt, Artificial Sequence
  synthetic polynucleotide
gaaauaccagucuuuuaaugaguaa

SEQ ID NO: 246 - RNA, 25 nt, Artificial Sequence
  synthetic polynucleotide
aaauaccagucuuuuaaugaguaca

SEQ ID NO: 247 - RNA, 25 nt, Artificial Sequence
  synthetic polynucleotide
aauaccagucuuuuaaugaguacca

SEQ ID NO: 248 - RNA, 25 nt, Artificial Sequence
  synthetic polynucleotide
auaccagucuuuuaaugaguaccga

SEQ ID NO: 249 - RNA, 25 nt, Artificial Sequence
  synthetic polynucleotide
uaccagucuuuuaaugaguaccgca

SEQ ID NO: 250 - RNA, 25 nt, Artificial Sequence
  synthetic polynucleotide
accagucuuuuaaugaguaccgcaa

SEQ ID NO: 251 - RNA, 25 nt, Artificial Sequence
  synthetic polynucleotide
ccagucuuuuaaugaguaccgcaaa

SEQ ID NO: 252 - RNA, 25 nt, Artificial Sequence
  synthetic polynucleotide
agucuuuuaaugaguaccgcaaaca

SEQ ID NO: 253 - RNA, 25 nt, Artificial Sequence
  synthetic polynucleotide
ucuuuuaaugaguaccgcaaacgca

SEQ ID NO: 254 - RNA, 25 nt, Artificial Sequence
  synthetic polynucleotide
cuuuuaaugaguaccgcaaacgcua

SEQ ID NO: 255 - RNA, 25 nt, Artificial Sequence
  synthetic polynucleotide
uuuuaaugaguaccgcaaacgcuua

SEQ ID NO: 256 - RNA, 25 nt, Artificial Sequence
  synthetic polynucleotide
aguaccgcaaacgcuuuaugcugaa

SEQ ID NO: 257 - RNA, 25 nt, Artificial Sequence
  synthetic polynucleotide
uaugaaucauuugaagaacuuacaa

SEQ ID NO: 258 - RNA, 25 nt, Artificial Sequence
  synthetic polynucleotide
augaaucauuugaagaacuuacaga

SEQ ID NO: 259 - RNA, 25 nt, Artificial Sequence
  synthetic polynucleotide
gaaucauuugaagaacuuacaggaa

SEQ ID NO: 260 - RNA, 25 nt, Artificial Sequence
  synthetic polynucleotide
aucauuugaagaacuuacaggagaa

SEQ ID NO: 261 - RNA, 25 nt, Artificial Sequence
  synthetic polynucleotide
cauuugaagaacuuacaggagaaaa

SEQ ID NO: 262 - RNA, 25 nt, Artificial Sequence
  synthetic polynucleotide
auuugaagaacuuacaggagaaaaa

SEQ ID NO: 263 - RNA, 25 nt, Artificial Sequence
  synthetic polynucleotide
ggaagcacucuauggugacaucgaa

SEQ ID NO: 264 - RNA, 25 nt, Artificial Sequence
  synthetic polynucleotide
uguauccugcccuucugguagaaaa

SEQ ID NO: 265 - RNA, 25 nt, Artificial Sequence
  synthetic polynucleotide
ccugcccuucugguagaaaagccua

SEQ ID NO: 266 - RNA, 25 nt, Artificial Sequence
  synthetic polynucleotide
aucuuuggugaaaccaugguagaaa

SEQ ID NO: 267 - RNA, 25 nt, Artificial Sequence
  synthetic polynucleotide
ugguagaaguuggagcaccauucua

SEQ ID NO: 268 - RNA, 25 nt, Artificial Sequence
  synthetic polynucleotide
uagaaguuggagcaccauucuccua

SEQ ID NO: 269 - RNA, 25 nt, Artificial Sequence
  synthetic polynucleotide
aaguuggagcaccauucuccuugaa

SEQ ID NO: 270 - RNA, 25 nt, Artificial Sequence
  synthetic polynucleotide
uuggagcaccauucuccuugaaaga

SEQ ID NO: 271 - RNA, 25 nt, Artificial Sequence
  synthetic polynucleotide
uggagcaccauucuccuugaaagga

SEQ ID NO: 272 - RNA, 25 nt, Artificial Sequence
  synthetic polynucleotide
ggagcaccauucuccuugaaaggaa

SEQ ID NO: 273 - RNA, 25 nt, Artificial Sequence
  synthetic polynucleotide
gagcaccauucuccuugaaaggaca

SEQ ID NO: 274 - RNA, 25 nt, Artificial Sequence
  synthetic polynucleotide
agcaccauucuccuugaaaggacua

SEQ ID NO: 275 - RNA, 25 nt, Artificial Sequence
  synthetic polynucleotide
gcaccauucuccuugaaaggacuua

SEQ ID NO: 276 - RNA, 25 nt, Artificial Sequence
  synthetic polynucleotide
caccauucuccuugaaaggacuuaa

SEQ ID NO: 277 - RNA, 25 nt, Artificial Sequence
  synthetic polynucleotide
accauucuccuugaaaggacuuaua

SEQ ID NO: 278 - RNA, 25 nt, Artificial Sequence
  synthetic polynucleotide
ccauucuccuugaaaggacuuauga

SEQ ID NO: 279 - RNA, 25 nt, Artificial Sequence
  synthetic polynucleotide
uggguuuucaaaucaucaacacuga

SEQ ID NO: 280 - RNA, 25 nt, Artificial Sequence
  synthetic polynucleotide
ggguuuucaaaucaucaacacugca

SEQ ID NO: 281 - RNA, 25 nt, Artificial Sequence
  synthetic polynucleotide
uuucaaaucaucaacacugccucaa

SEQ ID NO: 282 - RNA, 25 nt, Artificial Sequence
  synthetic polynucleotide
caaaucaucaacacugccucaauua

SEQ ID NO: 283 - RNA, 25 nt, Artificial Sequence
  synthetic polynucleotide
aucaucaacacugccucaauucaga

SEQ ID NO: 284 - RNA, 25 nt, Artificial Sequence
  synthetic polynucleotide
ucaucaacacugccucaauucagua

SEQ ID NO: 285 - RNA, 25 nt, Artificial Sequence
  synthetic polynucleotide
caucaacacugccucaauucaguca

SEQ ID NO: 286 - RNA, 25 nt, Artificial Sequence
  synthetic polynucleotide
aucaacacugccucaauucagucua

SEQ ID NO: 287 - RNA, 25 nt, Artificial Sequence
  synthetic polynucleotide
ucaacacugccucaauucagucuca

SEQ ID NO: 288 - RNA, 25 nt, Artificial Sequence
  synthetic polynucleotide
caacacugccucaauucagucucua

SEQ ID NO: 289 - RNA, 25 nt, Artificial Sequence
  synthetic polynucleotide
aacacugccucaauucagucucuca

SEQ ID NO: 290 - RNA, 25 nt, Artificial Sequence
  synthetic polynucleotide
acacugccucaauucagucucucaa

SEQ ID NO: 291 - RNA, 25 nt, Artificial Sequence
  synthetic polynucleotide
cacugccucaauucagucucucaua

SEQ ID NO: 292 - RNA, 25 nt, Artificial Sequence
  synthetic polynucleotide
acugccucaauucagucucucauca

SEQ ID NO: 293 - RNA, 25 nt, Artificial Sequence
  synthetic polynucleotide
cugccucaauucagucucucaucua

SEQ ID NO: 294 - RNA, 25 nt, Artificial Sequence
  synthetic polynucleotide
ugccucaauucagucucucaucuga

SEQ ID NO: 295 - RNA, 25 nt, Artificial Sequence
  synthetic polynucleotide
gccucaauucagucucucaucugca

SEQ ID NO: 296 - RNA, 25 nt, Artificial Sequence
  synthetic polynucleotide
ccucaauucagucucucaucugcaa

SEQ ID NO: 297 - RNA, 25 nt, Artificial Sequence
  synthetic polynucleotide
cucaauucagucucucaucugcaaa

SEQ ID NO: 298 - RNA, 25 nt, Artificial Sequence
  synthetic polynucleotide
aauucagucucucaucugcaauaaa

SEQ ID NO: 299 - RNA, 25 nt, Artificial Sequence
  synthetic polynucleotide
auucagucucucaucugcaauaaca

SEQ ID NO: 300 - RNA, 25 nt, Artificial Sequence
  synthetic polynucleotide
uucagucucucaucugcaauaacga

SEQ ID NO: 301 - RNA, 25 nt, Artificial Sequence
  synthetic polynucleotide
ucagucucucaucugcaauaacgua

SEQ ID NO: 302 - RNA, 25 nt, Artificial Sequence
  synthetic polynucleotide
cagucucucaucugcaauaacguga

SEQ ID NO: 303 - RNA, 25 nt, Artificial Sequence
  synthetic polynucleotide
agucucucaucugcaauaacgugaa

SEQ ID NO: 304 - RNA, 25 nt, Artificial Sequence
  synthetic polynucleotide
gucucucaucugcaauaacgugaaa

SEQ ID NO: 305 - RNA, 25 nt, Artificial Sequence
  synthetic polynucleotide
agagcucauuaaaacagucaccaua

SEQ ID NO: 306 - RNA, 25 nt, Artificial Sequence
  synthetic polynucleotide
gagcucauuaaaacagucaccauca

SEQ ID NO: 307 - RNA, 25 nt, Artificial Sequence
  synthetic polynucleotide
agcucauuaaaacagucaccaucaa

SEQ ID NO: 308 - RNA, 25 nt, Artificial Sequence
  synthetic polynucleotide
gcucauuaaaacagucaccaucaaa

SEQ ID NO: 309 - RNA, 25 nt, Artificial Sequence
  synthetic polynucleotide
cucauuaaaacagucaccaucaaua

SEQ ID NO: 310 - RNA, 25 nt, Artificial Sequence
  synthetic polynucleotide
ucauuaaaacagucaccaucaauga

SEQ ID NO: 311 - RNA, 25 nt, Artificial Sequence
  synthetic polynucleotide
cauuaaaacagucaccaucaaugca

SEQ ID NO: 312 - RNA, 25 nt, Artificial Sequence
  synthetic polynucleotide
uuaaaacagucaccaucaaugcaaa

SEQ ID NO: 313 - RNA, 25 nt, Artificial Sequence
  synthetic polynucleotide
uaaaacagucaccaucaaugcaaga

SEQ ID NO: 314 - RNA, 25 nt, Artificial Sequence
  synthetic polynucleotide
aaaacagucaccaucaaugcaagua

SEQ ID NO: 315 - RNA, 25 nt, Artificial Sequence
  synthetic polynucleotide
aacagucaccaucaaugcaaguuca

SEQ ID NO: 316 - RNA, 25 nt, Artificial Sequence
  synthetic polynucleotide
auaucaaucccacaguacuacuaaa

SEQ ID NO: 317 - RNA, 25 nt, Artificial Sequence
  synthetic polynucleotide
acuacuaaaagaacguucgacugaa

SEQ ID NO: 318 - RNA, 25 nt, Artificial Sequence
  synthetic polynucleotide
cguucgacugaacuguagaagucua

SEQ ID NO: 319 - RNA, 25 nt, Artificial Sequence
  synthetic polynucleotide
gacugaacuguagaagucuaaugaa

SEQ ID NO: 320 - RNA, 25 nt, Artificial Sequence
  synthetic polynucleotide
ugaacuguagaagucuaaugaucaa

SEQ ID NO: 321 - RNA, 25 nt, Artificial Sequence
  synthetic polynucleotide
uccuguugcggagaaaggagucaua

SEQ ID NO: 322 - RNA, 25 nt, Artificial Sequence
  synthetic polynucleotide
uugcggagaaaggagucauacuuga

SEQ ID NO: 323 - RNA, 25 nt, Artificial Sequence
  synthetic polynucleotide
cauacuugugaagacuuuuauguca

SEQ ID NO: 324 - RNA, 25 nt, Artificial Sequence
  synthetic polynucleotide
cuaaagauuuugcuguugcuguuaa

SEQ ID NO: 325 - RNA, 25 nt, Artificial Sequence
  synthetic polynucleotide
uguugcuguuaaguuuggaaaacaa

SEQ ID NO: 326 - RNA, 25 nt, Artificial Sequence
  synthetic polynucleotide
agagagaaaugaguuuugacgucua

SEQ ID NO: 327 - RNA, 25 nt, Artificial Sequence
  synthetic polynucleotide
uuauaagaacgaaaguaaagaugua

SEQ ID NO: 328 - RNA, 25 nt, Artificial Sequence
  synthetic polynucleotide
aagauggcaaaaugcugaaaguuua

SEQ ID NO: 329 - RNA, 25 nt, Artificial Sequence
  synthetic polynucleotide
uuacacugucgauguuuccaaugca

SEQ ID NO: 330 - RNA, 25 nt, Artificial Sequence
  synthetic polynucleotide
gacauuaccaguaauuucaugucua

SEQ ID NO: 331 - RNA, 25 nt, Artificial Sequence
  synthetic polynucleotide
caaaaagaagcugucuuggauuuaa

SEQ ID NO: 332 - RNA, 25 nt, Artificial Sequence
  synthetic polynucleotide
cuuuuucaccaagaguauaaaccua

SEQ ID NO: 333 - RNA, 25 nt, Artificial Sequence
  synthetic polynucleotide
augccaaauuuauuaagguggugga

SEQ ID NO: 334 - RNA, 25 nt, Artificial Sequence
  synthetic polynucleotide
guggagccacugcaguguuaucuua

SEQ ID NO: 335 - RNA, 25 nt, Artificial Sequence
  synthetic polynucleotide
ggagccacugcaguguuaucuuaaa

SEQ ID NO: 336 - RNA, 25 nt, Artificial Sequence
  synthetic polynucleotide
cagaauuuguuuauauggcugguaa

SEQ ID NO: 337 - RNA, 25 nt, Artificial Sequence
  synthetic polynucleotide
guuuauauggcugguaacauguaaa

SEQ ID NO: 338 - RNA, 25 nt, Artificial Sequence
  synthetic polynucleotide
uacucagauuuugcuaugagguuaa

SEQ ID NO: 339 - RNA, 25 nt, Artificial Sequence
  synthetic polynucleotide
cagauuuugcuaugagguuaaugaa

SEQ ID NO: 340 - RNA, 25 nt, Artificial Sequence
  synthetic polynucleotide
auuuugcuaugagguuaaugaagua

SEQ ID NO: 341 - RNA, 25 nt, Artificial Sequence
  synthetic polynucleotide
aaugaaguaccaagcugugcuugaa

SEQ ID NO: 342 - RNA, 25 nt, Artificial Sequence
  synthetic polynucleotide
aucacauugcaaaaguagcaaugaa

SEQ ID NO: 343 - RNA, 25 nt, Artificial Sequence
  synthetic polynucleotide
gcaaaaguagcaaugaccucauaaa

SEQ ID NO: 344 - RNA, 25 nt, Artificial Sequence
  synthetic polynucleotide
aaugaccucauaaaauaccucuuca

SEQ ID NO: 345 - RNA, 25 nt, Artificial Sequence
  synthetic polynucleotide
aauuuuaucucagucuugaagccaa

SEQ ID NO: 346 - RNA, 25 nt, Artificial Sequence
  synthetic polynucleotide
ucuugaagccaauucaguaggugca

SEQ ID NO: 347 - RNA, 25 nt, Artificial Sequence
  synthetic polynucleotide
aauucaguaggugcauuggaaucaa

SEQ ID NO: 348 - RNA, 25 nt, Artificial Sequence
  synthetic polynucleotide
uuucuucuuuuagccauuuugcuaa

SEQ ID NO: 349 - RNA, 25 nt, Artificial Sequence
  synthetic polynucleotide
uucuuuuagccauuuugcuaagaga

SEQ ID NO: 350 - RNA, 25 nt, Artificial Sequence
  synthetic polynucleotide
ccauuuugcuaagagacacagucua

SEQ ID NO: 351 - RNA, 25 nt, Artificial Sequence
  synthetic polynucleotide
uuacuaguuuuaagaucagaguuca

SEQ ID NO: 352 - RNA, 25 nt, Artificial Sequence
  synthetic polynucleotide
acucugccuauauuuucuuaccuga

SEQ ID NO: 353 - RNA, 25 nt, Artificial Sequence
  synthetic polynucleotide
ugaacuuuugcaaguuuucagguaa

SEQ ID NO: 354 - RNA, 25 nt, Artificial Sequence
  synthetic polynucleotide
gaacuuuugcaaguuuucagguaaa

SEQ ID NO: 355 - RNA, 25 nt, Artificial Sequence
  synthetic polynucleotide
uucagguaaaccucagcucaggaca

SEQ ID NO: 356 - RNA, 25 nt, Artificial Sequence
  synthetic polynucleotide
accucagcucaggacugcuauuuaa

SEQ ID NO: 357 - RNA, 25 nt, Artificial Sequence
  synthetic polynucleotide
cuuauuuuaagugaaaagcagagaa

SEQ ID NO: 358 - RNA, 25 nt, Artificial Sequence
  synthetic polynucleotide
uaucuguaaccaagauggaugcaaa

SEQ ID NO: 359 - RNA, 25 nt, Artificial Sequence
  synthetic polynucleotide
uuuuccacaucucauugucacugaa

SEQ ID NO: 360 - RNA, 25 nt, Artificial Sequence
  synthetic polynucleotide
acaucucauugucacugacauuuaa

SEQ ID NO: 361 - RNA, 25 nt, Artificial Sequence
  synthetic polynucleotide
gucuuauuaggacacuaugguuaua

SEQ ID NO: 362 - RNA, 25 nt, Artificial Sequence
  synthetic polynucleotide
cuuauuaggacacuaugguuauaaa

SEQ ID NO: 363 - RNA, 25 nt, Artificial Sequence
  synthetic polynucleotide
uuauuaggacacuaugguuauaaaa

SEQ ID NO: 364 - RNA, 25 nt, Artificial Sequence
  synthetic polynucleotide
ugguuauaaacuguguuuaagccua

SEQ ID NO: 365 - RNA, 25 nt, Artificial Sequence
  synthetic polynucleotide
auauuuaagguugaauguuugucca

SEQ ID NO: 366 - RNA, 25 nt, Artificial Sequence
  synthetic polynucleotide
cuagcccacaaagaauauugucuca

SEQ ID NO: 367 - RNA, 25 nt, Artificial Sequence
  synthetic polynucleotide
ucucauuagccugaaugugccauaa

SEQ ID NO: 368 - RNA, 25 nt, Artificial Sequence
  synthetic polynucleotide
aaugugccauaagacugaccuuuua

SEQ ID NO: 369 - RNA, 13 nt, Artificial Sequence
  synthetic polynucleotide
gaaaacugcucaa

SEQ ID NO: 370 - RNA, 19 nt, Artificial Sequence
  synthetic polynucleotide
uugagcaguuuucuccaua

SEQ ID NO: 371 - RNA, 13 nt, Artificial Sequence
  synthetic polynucleotide
accucuccuauua

SEQ ID NO: 372 - RNA, 19 nt, Artificial Sequence
  synthetic polynucleotide
uaauaggagagguuagaga

SEQ ID NO: 373 - RNA, 13 nt, Artificial Sequence
  synthetic polynucleotide
uccaccaacuuaa

SEQ ID NO: 374 - RNA, 19 nt, Artificial Sequence
  synthetic polynucleotide
uuaaguugguggacuguca

SEQ ID NO: 375 - RNA, 14 nt, Artificial Sequence
  synthetic polynucleotide
guccaccaacuuaa

SEQ ID NO: 376 - RNA, 19 nt, Artificial Sequence
  synthetic polynucleotide
uuaaguugguggacuguca

SEQ ID NO: 377 - RNA, 13 nt, Artificial Sequence
  synthetic polynucleotide
cuccuauuauaca

SEQ ID NO: 378 - RNA, 19 nt, Artificial Sequence
  synthetic polynucleotide
uguauaauaggagagguua

SEQ ID NO: 379 - RNA, 13 nt, Artificial Sequence
  synthetic polynucleotide
gaucacauuugaa

SEQ ID NO: 380 - RNA, 19 nt, Artificial Sequence
  synthetic polynucleotide
uucaaaugugaucuggaug

SEQ ID NO: 381 - RNA, 14 nt, Artificial Sequence
  synthetic polynucleotide
agaucacauuugaa

SEQ ID NO: 382 - RNA, 19 nt, Artificial Sequence
  synthetic polynucleotide
uucaaaugugaucuggaug

SEQ ID NO: 383 - RNA, 13 nt, Artificial Sequence
  synthetic polynucleotide
aaccucuccuaua

SEQ ID NO: 384 - RNA, 19 nt, Artificial Sequence
  synthetic polynucleotide
uauaggagagguuagagaa

SEQ ID NO: 385 - RNA, 13 nt, Artificial Sequence
  synthetic polynucleotide
guugacauccaga

SEQ ID NO: 386 - RNA, 19 nt, Artificial Sequence
  synthetic polynucleotide
ucuggaugucaacacauaa

SEQ ID NO: 387 - RNA, 13 nt, Artificial Sequence
  synthetic polynucleotide
ccuuccuucgaaa

SEQ ID NO: 388 - RNA, 19 nt, Artificial Sequence
  synthetic polynucleotide
uuucgaaggaagggaaugu

SEQ ID NO: 389 - RNA, 13 nt, Artificial Sequence
  synthetic polynucleotide
acuccaaacacaa

SEQ ID NO: 390 - RNA, 19 nt, Artificial Sequence
  synthetic polynucleotide
uuguguuuggaguggguuu

SEQ ID NO: 391 - RNA, 14 nt, Artificial Sequence
  synthetic polynucleotide
cacuccaaacacaa

SEQ ID NO: 392 - RNA, 19 nt, Artificial Sequence
  synthetic polynucleotide
uuguguuuggaguggguuu

SEQ ID NO: 393 - RNA, 13 nt, Artificial Sequence
  synthetic polynucleotide
cacuccaaacaca

SEQ ID NO: 394 - RNA, 19 nt, Artificial Sequence
  synthetic polynucleotide
uguguuuggaguggguuuc

SEQ ID NO: 395 - RNA, 13 nt, Artificial Sequence
  synthetic polynucleotide
ccaccaacuuaca

SEQ ID NO: 396 - RNA, 19 nt, Artificial Sequence
  synthetic polynucleotide
uguaaguugguggacuguc

SEQ ID NO: 397 - RNA, 14 nt, Artificial Sequence
  synthetic polynucleotide
uccaccaacuuaca

SEQ ID NO: 398 - RNA, 19 nt, Artificial Sequence
  synthetic polynucleotide
uguaaguugguggacuguc

SEQ ID NO: 399 - RNA, 13 nt, Artificial Sequence
  synthetic polynucleotide
aauaccagucuua

SEQ ID NO: 400 - RNA, 19 nt, Artificial Sequence
  synthetic polynucleotide
uaagacugguauuucaucu

SEQ ID NO: 401 - RNA, 13 nt, Artificial Sequence
  synthetic polynucleotide
gaccaguauaaga

SEQ ID NO: 402 - RNA, 19 nt, Artificial Sequence
  synthetic polynucleotide
ucuuauacuggucaaaucc

SEQ ID NO: 403 - RNA, 13 nt, Artificial Sequence
  synthetic polynucleotide
gucuuuuaaugaa

SEQ ID NO: 404 - RNA, 19 nt, Artificial Sequence
  synthetic polynucleotide
uucauuaaaagacugguau

SEQ ID NO: 405 - RNA, 13 nt, Artificial Sequence
  synthetic polynucleotide
aauuucaugucua

SEQ ID NO: 406 - RNA, 19 nt, Artificial Sequence
  synthetic polynucleotide
uagacaugaaauuacuggu

SEQ ID NO: 407 - RNA, 13 nt, Artificial Sequence
  synthetic polynucleotide
aucacauuugaua

SEQ ID NO: 408 - RNA, 19 nt, Artificial Sequence
  synthetic polynucleotide
uaucaaaugugaucuggau

SEQ ID NO: 409 - RNA, 14 nt, Artificial Sequence
  synthetic polynucleotide
gaucacauuugaua

SEQ ID NO: 410 - RNA, 19 nt, Artificial Sequence
  synthetic polynucleotide
uaucaaaugugaucuggau

SEQ ID NO: 411 - RNA, 13 nt, Artificial Sequence
  synthetic polynucleotide
uccagaucacaua

SEQ ID NO: 412 - RNA, 19 nt, Artificial Sequence
  synthetic polynucleotide
uaugugaucuggaugucaa

SEQ ID NO: 413 - RNA, 13 nt, Artificial Sequence
  synthetic polynucleotide
uacugauaggaga

SEQ ID NO: 414 - RNA, 19 nt, Artificial Sequence
  synthetic polynucleotide
ucuccuaucaguauuagcc

SEQ ID NO: 415 - RNA, 13 nt, Artificial Sequence
  synthetic polynucleotide
gugcaacacuuga

SEQ ID NO: 416 - RNA, 19 nt, Artificial Sequence
  synthetic polynucleotide
ucaaguguugcacauaauc

SEQ ID NO: 417 - RNA, 13 nt, Artificial Sequence
  synthetic polynucleotide
accaguauaagua

SEQ ID NO: 418 - RNA, 19 nt, Artificial Sequence
  synthetic polynucleotide
uacuuauacuggucaaauc

SEQ ID NO: 419 - RNA, 13 nt, Artificial Sequence
  synthetic polynucleotide
gaagucuaaugaa

SEQ ID NO: 420 - RNA, 19 nt, Artificial Sequence
  synthetic polynucleotide
uucauuagacuucuacagu

SEQ ID NO: 421 - RNA, 13 nt, Artificial Sequence
  synthetic polynucleotide
aagaagaaaguua

SEQ ID NO: 422 - RNA, 19 nt, Artificial Sequence
  synthetic polynucleotide
uaacuuucuucuuagaagc

SEQ ID NO: 423 - RNA, 13 nt, Artificial Sequence
  synthetic polynucleotide
ucacauuugauua

SEQ ID NO: 424 - RNA, 19 nt, Artificial Sequence
  synthetic polynucleotide
uaaucaaaugugaucugga

SEQ ID NO: 425 - RNA, 14 nt, Artificial Sequence
  synthetic polynucleotide
aucacauuugauua

SEQ ID NO: 426 - RNA, 19 nt, Artificial Sequence
  synthetic polynucleotide
uaaucaaaugugaucugga

SEQ ID NO: 427 - RNA, 13 nt, Artificial Sequence
  synthetic polynucleotide
acauuugauugaa

SEQ ID NO: 428 - RNA, 19 nt, Artificial Sequence
  synthetic polynucleotide
uucaaucaaaugugaucug

SEQ ID NO: 429 - RNA, 14 nt, Artificial Sequence
  synthetic polynucleotide
cacauuugauugaa

SEQ ID NO: 430 - RNA, 19 nt, Artificial Sequence
  synthetic polynucleotide
uucaaucaaaugugaucug

SEQ ID NO: 431 - RNA, 13 nt, Artificial Sequence
  synthetic polynucleotide
auuugauugacaa

SEQ ID NO: 432 - RNA, 19 nt, Artificial Sequence
  synthetic polynucleotide
uugucaaucaaaugugauc

SEQ ID NO: 433 - RNA, 14 nt, Artificial Sequence
  synthetic polynucleotide
cauuugauugacaa

SEQ ID NO: 434 - RNA, 19 nt, Artificial Sequence
  synthetic polynucleotide
uugucaaucaaaugugauc

SEQ ID NO: 435 - RNA, 13 nt, Artificial Sequence
  synthetic polynucleotide
caucugcaauaaa

SEQ ID NO: 436 - RNA, 19 nt, Artificial Sequence
  synthetic polynucleotide
uuuauugcagaugagagac

SEQ ID NO: 437 - RNA, 14 nt, Artificial Sequence
  synthetic polynucleotide
ucaucugcaauaaa

SEQ ID NO: 438 - RNA, 19 nt, Artificial Sequence
  synthetic polynucleotide
uuuauugcagaugagagac

SEQ ID NO: 439 - RNA, 13 nt, Artificial Sequence
  synthetic polynucleotide
cacagcauauaua

SEQ ID NO: 440 - RNA, 19 nt, Artificial Sequence
  synthetic polynucleotide
uauauaugcuguguguacu

SEQ ID NO: 441 - RNA, 13 nt, Artificial Sequence
  synthetic polynucleotide
cagcauauauaua

SEQ ID NO: 442 - RNA, 19 nt, Artificial Sequence
  synthetic polynucleotide
uauauauaugcugugugua

SEQ ID NO: 443 - RNA, 13 nt, Artificial Sequence
  synthetic polynucleotide
guacauugacuua

SEQ ID NO: 444 - RNA, 19 nt, Artificial Sequence
  synthetic polynucleotide
uaagucaauguacagcugc

SEQ ID NO: 445 - RNA, 14 nt, Artificial Sequence
  synthetic polynucleotide
uguacauugacuua

SEQ ID NO: 446 - RNA, 19 nt, Artificial Sequence
  synthetic polynucleotide
uaagucaauguacagcugc

SEQ ID NO: 447 - RNA, 13 nt, Artificial Sequence
  synthetic polynucleotide
aacuauugcuuca

SEQ ID NO: 448 - RNA, 19 nt, Artificial Sequence
  synthetic polynucleotide
ugaagcaauaguugguguc

SEQ ID NO: 449 - RNA, 14 nt, Artificial Sequence
  synthetic polynucleotide
caacuauugcuuca

SEQ ID NO: 450 - RNA, 19 nt, Artificial Sequence
  synthetic polynucleotide
ugaagcaauaguugguguc

SEQ ID NO: 451 - RNA, 13 nt, Artificial Sequence
  synthetic polynucleotide
gcauauauaugua

SEQ ID NO: 452 - RNA, 19 nt, Artificial Sequence
  synthetic polynucleotide
uacauauauaugcugugug

SEQ ID NO: 453 - RNA, 13 nt, Artificial Sequence
  synthetic polynucleotide
uguacauugacua

SEQ ID NO: 454 - RNA, 19 nt, Artificial Sequence
  synthetic polynucleotide
uagucaauguacagcugcc

SEQ ID NO: 455 - RNA, 14 nt, Artificial Sequence
  synthetic polynucleotide
cuguacauugacua

SEQ ID NO: 456 - RNA, 19 nt, Artificial Sequence
  synthetic polynucleotide
uagucaauguacagcugcc

SEQ ID NO: 457 - RNA, 13 nt, Artificial Sequence
  synthetic polynucleotide
agcauauauauga

SEQ ID NO: 458 - RNA, 19 nt, Artificial Sequence
  synthetic polynucleotide
ucauauauaugcugugugu

SEQ ID NO: 459 - RNA, 13 nt, Artificial Sequence
  synthetic polynucleotide
cagcaacaauuca

SEQ ID NO: 460 - RNA, 19 nt, Artificial Sequence
  synthetic polynucleotide
ugaauuguugcuguauuuc

SEQ ID NO: 461 - RNA, 13 nt, Artificial Sequence
  synthetic polynucleotide
cauauauauguua

SEQ ID NO: 462 - RNA, 19 nt, Artificial Sequence
  synthetic polynucleotide
uaacauauauaugcugugu

SEQ ID NO: 463 - RNA, 13 nt, Artificial Sequence
  synthetic polynucleotide
uugcuucagcuca

SEQ ID NO: 464 - RNA, 19 nt, Artificial Sequence
  synthetic polynucleotide
ugagcugaagcaauaguug

SEQ ID NO: 465 - RNA, 14 nt, Artificial Sequence
  synthetic polynucleotide
auugcuucagcuca

SEQ ID NO: 466 - RNA, 19 nt, Artificial Sequence
  synthetic polynucleotide
ugagcugaagcaauaguug

SEQ ID NO: 467 - RNA, 13 nt, Artificial Sequence
  synthetic polynucleotide
acagcauauauaa

SEQ ID NO: 468 - RNA, 19 nt, Artificial Sequence
  synthetic polynucleotide
uuauauaugcuguguguac

SEQ ID NO: 469 - RNA, 13 nt, Artificial Sequence
  synthetic polynucleotide
auugcuucagcua

SEQ ID NO: 470 - RNA, 19 nt, Artificial Sequence
  synthetic polynucleotide
uagcugaagcaauaguugg

SEQ ID NO: 471 - RNA, 14 nt, Artificial Sequence
  synthetic polynucleotide
uauugcuucagcua

SEQ ID NO: 472 - RNA, 19 nt, Artificial Sequence
  synthetic polynucleotide
uagcugaagcaauaguugg

SEQ ID NO: 473 - RNA, 13 nt, Artificial Sequence
  synthetic polynucleotide
cagaguacacaca

SEQ ID NO: 474 - RNA, 19 nt, Artificial Sequence
  synthetic polynucleotide
uguguguacucugcuugaa

SEQ ID NO: 475 - RNA, 13 nt, Artificial Sequence
  synthetic polynucleotide
ucaagcagaguaa

SEQ ID NO: 476 - RNA, 19 nt, Artificial Sequence
  synthetic polynucleotide
uuacucugcuugaacuugu

SEQ ID NO: 477 - RNA, 13 nt, Artificial Sequence
  synthetic polynucleotide
agcagaguacaca

SEQ ID NO: 478 - RNA, 19 nt, Artificial Sequence
  synthetic polynucleotide
uguguacucugcuugaacu

SEQ ID NO: 479 - RNA, 13 nt, Artificial Sequence
  synthetic polynucleotide
gacaaguucaaga

SEQ ID NO: 480 - RNA, 19 nt, Artificial Sequence
  synthetic polynucleotide
ucuugaacuugucauagau

SEQ ID NO: 481 - RNA, 13 nt, Artificial Sequence
  synthetic polynucleotide
cuaugacaaguua

SEQ ID NO: 482 - RNA, 19 nt, Artificial Sequence
  synthetic polynucleotide
uaacuugucauagauuucg

SEQ ID NO: 483 - RNA, 13 nt, Artificial Sequence
  synthetic polynucleotide
gcagaguacacaa

SEQ ID NO: 484 - RNA, 19 nt, Artificial Sequence
  synthetic polynucleotide
uuguguacucugcuugaac

SEQ ID NO: 485 - RNA, 13 nt, Artificial Sequence
  synthetic polynucleotide
ugacaaguucaaa

SEQ ID NO: 486 - RNA, 19 nt, Artificial Sequence
  synthetic polynucleotide
uuugaacuugucauagauu

SEQ ID NO: 487 - RNA, 13 nt, Artificial Sequence
  synthetic polynucleotide
uacacacagcaua

SEQ ID NO: 488 - RNA, 19 nt, Artificial Sequence
  synthetic polynucleotide
uaugcuguguguacucugc

SEQ ID NO: 489 - RNA, 13 nt, Artificial Sequence
  synthetic polynucleotide
aacgaaaucuaua

SEQ ID NO: 490 - RNA, 19 nt, Artificial Sequence
  synthetic polynucleotide
uauagauuucguugugggu

SEQ ID NO: 491 - RNA, 13 nt, Artificial Sequence
  synthetic polynucleotide
uugacuuccgcaa

SEQ ID NO: 492 - RNA, 19 nt, Artificial Sequence
  synthetic polynucleotide
uugcggaagucaauguaca

SEQ ID NO: 493 - RNA, 13 nt, Artificial Sequence
  synthetic polynucleotide
acaacgaaaucua

SEQ ID NO: 494 - RNA, 19 nt, Artificial Sequence
  synthetic polynucleotide
uagauuucguuguggguuu

SEQ ID NO: 495 - RNA, 13 nt, Artificial Sequence
  synthetic polynucleotide
ucaacacaucaga

SEQ ID NO: 496 - RNA, 19 nt, Artificial Sequence
  synthetic polynucleotide
ucugauguguugaagaaca

SEQ ID NO: 497 - RNA, 13 nt, Artificial Sequence
  synthetic polynucleotide
acaaguucaagca

SEQ ID NO: 498 - RNA, 19 nt, Artificial Sequence
  synthetic polynucleotide
ugcuugaacuugucauaga

SEQ ID NO: 499 - RNA, 13 nt, Artificial Sequence
  synthetic polynucleotide
aucuaugacaaga

SEQ ID NO: 500 - RNA, 19 nt, Artificial Sequence
  synthetic polynucleotide
ucuugucauagauuucguu

SEQ ID NO: 501 - RNA, 20 nt, Artificial Sequence
  synthetic polynucleotide
uaucaaaugugaucuggaug

SEQ ID NO: 502 - RNA, 14 nt, Artificial Sequence
  synthetic polynucleotide
gaucacauuugaua

SEQ ID NO: 503 - RNA, 13 nt, Artificial Sequence
  synthetic polynucleotide
gaaauauagcaaa

SEQ ID NO: 504 - RNA, 19 nt, Artificial Sequence
  synthetic polynucleotide
uuugcuauauuucugguag

SEQ ID NO: 505 - RNA, 13 nt, Artificial Sequence
  synthetic polynucleotide
gaacucuaccaga

SEQ ID NO: 506 - RNA, 19 nt, Artificial Sequence
  synthetic polynucleotide
ucugguagaguucuacgug

SEQ ID NO: 507 - RNA, 13 nt, Artificial Sequence
  synthetic polynucleotide
gcaaagauaauga

SEQ ID NO: 508 - RNA, 19 nt, Artificial Sequence
  synthetic polynucleotide
ucauuaucuuugcugucac

SEQ ID NO: 509 - RNA, 13 nt, Artificial Sequence
  synthetic polynucleotide
aacucuaccagaa

SEQ ID NO: 510 - RNA, 19 nt, Artificial Sequence
  synthetic polynucleotide
uucugguagaguucuacgu

SEQ ID NO: 511 - RNA, 13 nt, Artificial Sequence
  synthetic polynucleotide
acucuaccagaaa

SEQ ID NO: 512 - RNA, 19 nt, Artificial Sequence
  synthetic polynucleotide
uuucugguagaguucuacg

SEQ ID NO: 513 - RNA, 13 nt, Artificial Sequence
  synthetic polynucleotide
acagcaaagauaa

SEQ ID NO: 514 - RNA, 19 nt, Artificial Sequence
  synthetic polynucleotide
uuaucuuugcugucacaag

SEQ ID NO: 515 - RNA, 13 nt, Artificial Sequence
  synthetic polynucleotide
caaucuaugacaa

SEQ ID NO: 516 - RNA, 19 nt, Artificial Sequence
  synthetic polynucleotide
uugucauagauugcguugu

SEQ ID NO: 517 - RNA, 13 nt, Artificial Sequence
  synthetic polynucleotide
agauucaagucaa

SEQ ID NO: 518 - RNA, 19 nt, Artificial Sequence
  synthetic polynucleotide
uugacuugaaucucugcag

SEQ ID NO: 519 - RNA, 13 nt, Artificial Sequence
  synthetic polynucleotide
cuguggagcaaca

SEQ ID NO: 520 - RNA, 19 nt, Artificial Sequence
  synthetic polynucleotide
uguugcuccacaguugacu

SEQ ID NO: 521 - RNA, 13 nt, Artificial Sequence
  synthetic polynucleotide
ugacagcaaagaa

SEQ ID NO: 522 - RNA, 19 nt, Artificial Sequence
  synthetic polynucleotide
uucuuugcugucacaagag

SEQ ID NO: 523 - RNA, 13 nt, Artificial Sequence
  synthetic polynucleotide
augacaaaaccaa

SEQ ID NO: 524 - RNA, 19 nt, Artificial Sequence
  synthetic polynucleotide
uugguuuugucauagauug

SEQ ID NO: 525 - RNA, 13 nt, Artificial Sequence
  synthetic polynucleotide
gagauucaaguca

SEQ ID NO: 526 - RNA, 19 nt, Artificial Sequence
  synthetic polynucleotide
ugacuugaaucucugcagg

SEQ ID NO: 527 - RNA, 25 nt, Artificial Sequence
  synthetic polynucleotide
cgcgggacuauccaccugcaagaca

SEQ ID NO: 528 - RNA, 25 nt, Artificial Sequence
  synthetic polynucleotide
cgggacuauccaccugcaagacuaa

SEQ ID NO: 529 - RNA, 25 nt, Artificial Sequence
  synthetic polynucleotide
gggacuauccaccugcaagacuaua

SEQ ID NO: 530 - RNA, 25 nt, Artificial Sequence
  synthetic polynucleotide
cuauccaccugcaagacuaucgaca

SEQ ID NO: 531 - RNA, 25 nt, Artificial Sequence
  synthetic polynucleotide
uauccaccugcaagacuaucgacaa

SEQ ID NO: 532 - RNA, 25 nt, Artificial Sequence
  synthetic polynucleotide
uccaccugcaagacuaucgacauga

SEQ ID NO: 533 - RNA, 25 nt, Artificial Sequence
  synthetic polynucleotide
ccaccugcaagacuaucgacaugga

SEQ ID NO: 534 - RNA, 25 nt, Artificial Sequence
  synthetic polynucleotide
caccugcaagacuaucgacauggaa

SEQ ID NO: 535 - RNA, 25 nt, Artificial Sequence
  synthetic polynucleotide
accugcaagacuaucgacauggaga

SEQ ID NO: 536 - RNA, 25 nt, Artificial Sequence
  synthetic polynucleotide
ccugcaagacuaucgacauggagca

SEQ ID NO: 537 - RNA, 25 nt, Artificial Sequence
  synthetic polynucleotide
aaugguggaaacccacaacgaaaua

SEQ ID NO: 538 - RNA, 25 nt, Artificial Sequence
  synthetic polynucleotide
augguggaaacccacaacgaaauca

SEQ ID NO: 539 - RNA, 25 nt, Artificial Sequence
  synthetic polynucleotide
ugguggaaacccacaacgaaaucua

SEQ ID NO: 540 - RNA, 25 nt, Artificial Sequence
  synthetic polynucleotide
gguggaaacccacaacgaaaucuaa

SEQ ID NO: 541 - RNA, 25 nt, Artificial Sequence
  synthetic polynucleotide
guggaaacccacaacgaaaucuaua

SEQ ID NO: 542 - RNA, 25 nt, Artificial Sequence
  synthetic polynucleotide
uggaaacccacaacgaaaucuauga

SEQ ID NO: 543 - RNA, 25 nt, Artificial Sequence
  synthetic polynucleotide
ggaaacccacaacgaaaucuaugaa

SEQ ID NO: 544 - RNA, 25 nt, Artificial Sequence
  synthetic polynucleotide
gaaacccacaacgaaaucuaugaca

SEQ ID NO: 545 - RNA, 25 nt, Artificial Sequence
  synthetic polynucleotide
aaacccacaacgaaaucuaugacaa

SEQ ID NO: 546 - RNA, 25 nt, Artificial Sequence
  synthetic polynucleotide
aacccacaacgaaaucuaugacaaa

SEQ ID NO: 547 - RNA, 25 nt, Artificial Sequence
  synthetic polynucleotide
acccacaacgaaaucuaugacaaga

SEQ ID NO: 548 - RNA, 25 nt, Artificial Sequence
  synthetic polynucleotide
cccacaacgaaaucuaugacaagua

SEQ ID NO: 549 - RNA, 25 nt, Artificial Sequence
  synthetic polynucleotide
ccacaacgaaaucuaugacaaguua

SEQ ID NO: 550 - RNA, 25 nt, Artificial Sequence
  synthetic polynucleotide
cacaacgaaaucuaugacaaguuca

SEQ ID NO: 551 - RNA, 25 nt, Artificial Sequence
  synthetic polynucleotide
caacgaaaucuaugacaaguucaaa

SEQ ID NO: 552 - RNA, 25 nt, Artificial Sequence
  synthetic polynucleotide
aacgaaaucuaugacaaguucaaga

SEQ ID NO: 553 - RNA, 25 nt, Artificial Sequence
  synthetic polynucleotide
acgaaaucuaugacaaguucaagca

SEQ ID NO: 554 - RNA, 25 nt, Artificial Sequence
  synthetic polynucleotide
cgaaaucuaugacaaguucaagcaa

SEQ ID NO: 555 - RNA, 25 nt, Artificial Sequence
  synthetic polynucleotide
gaaaucuaugacaaguucaagcaga

SEQ ID NO: 556 - RNA, 25 nt, Artificial Sequence
  synthetic polynucleotide
aaaucuaugacaaguucaagcagaa

SEQ ID NO: 557 - RNA, 25 nt, Artificial Sequence
  synthetic polynucleotide
aaucuaugacaaguucaagcagaga

SEQ ID NO: 558 - RNA, 25 nt, Artificial Sequence
  synthetic polynucleotide
aucuaugacaaguucaagcagagua

SEQ ID NO: 559 - RNA, 25 nt, Artificial Sequence
  synthetic polynucleotide
ucuaugacaaguucaagcagaguaa

SEQ ID NO: 560 - RNA, 25 nt, Artificial Sequence
  synthetic polynucleotide
cuaugacaaguucaagcagaguaca

SEQ ID NO: 561 - RNA, 25 nt, Artificial Sequence
  synthetic polynucleotide
uaugacaaguucaagcagaguacaa

SEQ ID NO: 562 - RNA, 25 nt, Artificial Sequence
  synthetic polynucleotide
augacaaguucaagcagaguacaca

SEQ ID NO: 563 - RNA, 25 nt, Artificial Sequence
  synthetic polynucleotide
ugacaaguucaagcagaguacacaa

SEQ ID NO: 564 - RNA, 25 nt, Artificial Sequence
  synthetic polynucleotide
gacaaguucaagcagaguacacaca

SEQ ID NO: 565 - RNA, 25 nt, Artificial Sequence
  synthetic polynucleotide
acaaguucaagcagaguacacacaa

SEQ ID NO: 566 - RNA, 25 nt, Artificial Sequence
  synthetic polynucleotide
aaguucaagcagaguacacacagca

SEQ ID NO: 567 - RNA, 25 nt, Artificial Sequence
  synthetic polynucleotide
aguucaagcagaguacacacagcaa

SEQ ID NO: 568 - RNA, 25 nt, Artificial Sequence
  synthetic polynucleotide
guucaagcagaguacacacagcaua

SEQ ID NO: 569 - RNA, 25 nt, Artificial Sequence
  synthetic polynucleotide
uucaagcagaguacacacagcauaa

SEQ ID NO: 570 - RNA, 25 nt, Artificial Sequence
  synthetic polynucleotide
ucaagcagaguacacacagcauaua

SEQ ID NO: 571 - RNA, 25 nt, Artificial Sequence
  synthetic polynucleotide
caagcagaguacacacagcauauaa

SEQ ID NO: 572 - RNA, 25 nt, Artificial Sequence
  synthetic polynucleotide
aagcagaguacacacagcauauaua

SEQ ID NO: 573 - RNA, 25 nt, Artificial Sequence
  synthetic polynucleotide
agcagaguacacacagcauauauaa

SEQ ID NO: 574 - RNA, 25 nt, Artificial Sequence
  synthetic polynucleotide
gcagaguacacacagcauauauaua

SEQ ID NO: 575 - RNA, 25 nt, Artificial Sequence
  synthetic polynucleotide
cagaguacacacagcauauauauga

SEQ ID NO: 576 - RNA, 25 nt, Artificial Sequence
  synthetic polynucleotide
agaguacacacagcauauauaugua

SEQ ID NO: 577 - RNA, 25 nt, Artificial Sequence
  synthetic polynucleotide
gaguacacacagcauauauauguua

SEQ ID NO: 578 - RNA, 25 nt, Artificial Sequence
  synthetic polynucleotide
aguacacacagcauauauauguuca

SEQ ID NO: 579 - RNA, 25 nt, Artificial Sequence
  synthetic polynucleotide
uacacacagcauauauauguucuua

SEQ ID NO: 580 - RNA, 25 nt, Artificial Sequence
  synthetic polynucleotide
gcauauauauguucuucaacacaua

SEQ ID NO: 581 - RNA, 25 nt, Artificial Sequence
  synthetic polynucleotide
cauauauauguucuucaacacauca

SEQ ID NO: 582 - RNA, 25 nt, Artificial Sequence
  synthetic polynucleotide
auauauauguucuucaacacaucaa

SEQ ID NO: 583 - RNA, 25 nt, Artificial Sequence
  synthetic polynucleotide
uauauauguucuucaacacaucaga

SEQ ID NO: 584 - RNA, 25 nt, Artificial Sequence
  synthetic polynucleotide
auauauguucuucaacacaucagaa

SEQ ID NO: 585 - RNA, 25 nt, Artificial Sequence
  synthetic polynucleotide
uauauguucuucaacacaucagaga

SEQ ID NO: 586 - RNA, 25 nt, Artificial Sequence
  synthetic polynucleotide
auauguucuucaacacaucagagca

SEQ ID NO: 587 - RNA, 25 nt, Artificial Sequence
  synthetic polynucleotide
uauguucuucaacacaucagagcua

SEQ ID NO: 588 - RNA, 25 nt, Artificial Sequence
  synthetic polynucleotide
auguucuucaacacaucagagcuca

SEQ ID NO: 589 - RNA, 25 nt, Artificial Sequence
  synthetic polynucleotide
gcugcgucugcugaggcucaaguua

SEQ ID NO: 590 - RNA, 25 nt, Artificial Sequence
  synthetic polynucleotide
cugcgucugcugaggcucaaguuaa

SEQ ID NO: 591 - RNA, 25 nt, Artificial Sequence
  synthetic polynucleotide
ugcgucugcugaggcucaaguuaaa

SEQ ID NO: 592 - RNA, 25 nt, Artificial Sequence
  synthetic polynucleotide
gcgucugcugaggcucaaguuaaaa

SEQ ID NO: 593 - RNA, 25 nt, Artificial Sequence
  synthetic polynucleotide
cgucugcugaggcucaaguuaaaaa

SEQ ID NO: 594 - RNA, 25 nt, Artificial Sequence
  synthetic polynucleotide
gucugcugaggcucaaguuaaaaga

SEQ ID NO: 595 - RNA, 25 nt, Artificial Sequence
  synthetic polynucleotide
ucugcugaggcucaaguuaaaagua

SEQ ID NO: 596 - RNA, 25 nt, Artificial Sequence
  synthetic polynucleotide
cugcugaggcucaaguuaaaaguga

SEQ ID NO: 597 - RNA, 25 nt, Artificial Sequence
  synthetic polynucleotide
ugcugaggcucaaguuaaaagugga

SEQ ID NO: 598 - RNA, 25 nt, Artificial Sequence
  synthetic polynucleotide
gcugaggcucaaguuaaaaguggaa

SEQ ID NO: 599 - RNA, 25 nt, Artificial Sequence
  synthetic polynucleotide
cugaggcucaaguuaaaaguggaga

SEQ ID NO: 600 - RNA, 25 nt, Artificial Sequence
  synthetic polynucleotide
ugaggcucaaguuaaaaguggagca

SEQ ID NO: 601 - RNA, 25 nt, Artificial Sequence
  synthetic polynucleotide
gaggcucaaguuaaaaguggagcaa

SEQ ID NO: 602 - RNA, 25 nt, Artificial Sequence
  synthetic polynucleotide
aggcucaaguuaaaaguggagcaga

SEQ ID NO: 603 - RNA, 25 nt, Artificial Sequence
  synthetic polynucleotide
ggcucaaguuaaaaguggagcagca

SEQ ID NO: 604 - RNA, 25 nt, Artificial Sequence
  synthetic polynucleotide
gcucaaguuaaaaguggagcagcaa

SEQ ID NO: 605 - RNA, 25 nt, Artificial Sequence
  synthetic polynucleotide
cucaaguuaaaaguggagcagcaca

SEQ ID NO: 606 - RNA, 25 nt, Artificial Sequence
  synthetic polynucleotide
ucaaguuaaaaguggagcagcacga

SEQ ID NO: 607 - RNA, 25 nt, Artificial Sequence
  synthetic polynucleotide
cagcacguggagcuguaccagaaaa

SEQ ID NO: 608 - RNA, 25 nt, Artificial Sequence
  synthetic polynucleotide
agcacguggagcuguaccagaaaua

SEQ ID NO: 609 - RNA, 25 nt, Artificial Sequence
  synthetic polynucleotide
gcacguggagcuguaccagaaauaa

SEQ ID NO: 610 - RNA, 25 nt, Artificial Sequence
  synthetic polynucleotide
cacguggagcuguaccagaaauaca

SEQ ID NO: 611 - RNA, 25 nt, Artificial Sequence
  synthetic polynucleotide
acguggagcuguaccagaaauacaa

SEQ ID NO: 612 - RNA, 25 nt, Artificial Sequence
  synthetic polynucleotide
cguggagcuguaccagaaauacaga

SEQ ID NO: 613 - RNA, 25 nt, Artificial Sequence
  synthetic polynucleotide
guggagcuguaccagaaauacagca

SEQ ID NO: 614 - RNA, 25 nt, Artificial Sequence
  synthetic polynucleotide
uggagcuguaccagaaauacagcaa

SEQ ID NO: 615 - RNA, 25 nt, Artificial Sequence
  synthetic polynucleotide
ggagcuguaccagaaauacagcaaa

SEQ ID NO: 616 - RNA, 25 nt, Artificial Sequence
  synthetic polynucleotide
gagcuguaccagaaauacagcaaca

SEQ ID NO: 617 - RNA, 25 nt, Artificial Sequence
  synthetic polynucleotide
agcuguaccagaaauacagcaacaa

SEQ ID NO: 618 - RNA, 25 nt, Artificial Sequence
  synthetic polynucleotide
gcuguaccagaaauacagcaacaaa

SEQ ID NO: 619 - RNA, 25 nt, Artificial Sequence
  synthetic polynucleotide
cuguaccagaaauacagcaacaaua

SEQ ID NO: 620 - RNA, 25 nt, Artificial Sequence
  synthetic polynucleotide
uguaccagaaauacagcaacaauua

SEQ ID NO: 621 - RNA, 25 nt, Artificial Sequence
  synthetic polynucleotide
guaccagaaauacagcaacaauuca

SEQ ID NO: 622 - RNA, 25 nt, Artificial Sequence
  synthetic polynucleotide
uaccagaaauacagcaacaauucca

SEQ ID NO: 623 - RNA, 25 nt, Artificial Sequence
  synthetic polynucleotide
accagaaauacagcaacaauuccua

SEQ ID NO: 624 - RNA, 25 nt, Artificial Sequence
  synthetic polynucleotide
ccagaaauacagcaacaauuccuga

SEQ ID NO: 625 - RNA, 25 nt, Artificial Sequence
  synthetic polynucleotide
cagaaauacagcaacaauuccugga

SEQ ID NO: 626 - RNA, 25 nt, Artificial Sequence
  synthetic polynucleotide
aaauacagcaacaauuccuggcgaa

SEQ ID NO: 627 - RNA, 25 nt, Artificial Sequence
  synthetic polynucleotide
aauacagcaacaauuccuggcgaua

SEQ ID NO: 628 - RNA, 25 nt, Artificial Sequence
  synthetic polynucleotide
auacagcaacaauuccuggcgauaa

SEQ ID NO: 629 - RNA, 25 nt, Artificial Sequence
  synthetic polynucleotide
uacagcaacaauuccuggcgauaca

SEQ ID NO: 630 - RNA, 25 nt, Artificial Sequence
  synthetic polynucleotide
acagcaacaauuccuggcgauacca

SEQ ID NO: 631 - RNA, 25 nt, Artificial Sequence
  synthetic polynucleotide
agcaacaauuccuggcgauaccuca

SEQ ID NO: 632 - RNA, 25 nt, Artificial Sequence
  synthetic polynucleotide
agcgacucgccagagugguuaucua

SEQ ID NO: 633 - RNA, 25 nt, Artificial Sequence
  synthetic polynucleotide
gcgacucgccagagugguuaucuua

SEQ ID NO: 634 - RNA, 25 nt, Artificial Sequence
  synthetic polynucleotide
cgacucgccagagugguuaucuuua

SEQ ID NO: 635 - RNA, 25 nt, Artificial Sequence
  synthetic polynucleotide
gacucgccagagugguuaucuuuua

SEQ ID NO: 636 - RNA, 25 nt, Artificial Sequence
  synthetic polynucleotide
acucgccagagugguuaucuuuuga

SEQ ID NO: 637 - RNA, 25 nt, Artificial Sequence
  synthetic polynucleotide
cucgccagagugguuaucuuuugaa

SEQ ID NO: 638 - RNA, 25 nt, Artificial Sequence
  synthetic polynucleotide
ucgccagagugguuaucuuuugaua

SEQ ID NO: 639 - RNA, 25 nt, Artificial Sequence
  synthetic polynucleotide
cgccagagugguuaucuuuugauga

SEQ ID NO: 640 - RNA, 25 nt, Artificial Sequence
  synthetic polynucleotide
gccagagugguuaucuuuugaugua

SEQ ID NO: 641 - RNA, 25 nt, Artificial Sequence
  synthetic polynucleotide
ccagagugguuaucuuuugauguca

SEQ ID NO: 642 - RNA, 25 nt, Artificial Sequence
  synthetic polynucleotide
cagagugguuaucuuuugaugucaa

SEQ ID NO: 643 - RNA, 25 nt, Artificial Sequence
  synthetic polynucleotide
agagugguuaucuuuugaugucaca

SEQ ID NO: 644 - RNA, 25 nt, Artificial Sequence
  synthetic polynucleotide
gagugguuaucuuuugaugucacca

SEQ ID NO: 645 - RNA, 25 nt, Artificial Sequence
  synthetic polynucleotide
agugguuaucuuuugaugucaccga

SEQ ID NO: 646 - RNA, 25 nt, Artificial Sequence
  synthetic polynucleotide
gugguuaucuuuugaugucaccgga

SEQ ID NO: 647 - RNA, 25 nt, Artificial Sequence
  synthetic polynucleotide
ugguuaucuuuugaugucaccggaa

SEQ ID NO: 648 - RNA, 25 nt, Artificial Sequence
  synthetic polynucleotide
gguuaucuuuugaugucaccggaga

SEQ ID NO: 649 - RNA, 25 nt, Artificial Sequence
  synthetic polynucleotide
guuaucuuuugaugucaccggagua

SEQ ID NO: 650 - RNA, 25 nt, Artificial Sequence
  synthetic polynucleotide
uuaucuuuugaugucaccggaguua

SEQ ID NO: 651 - RNA, 25 nt, Artificial Sequence
  synthetic polynucleotide
uaucuuuugaugucaccggaguuga

SEQ ID NO: 652 - RNA, 25 nt, Artificial Sequence
  synthetic polynucleotide
cagcagggauaacacacugcaagua

SEQ ID NO: 653 - RNA, 25 nt, Artificial Sequence
  synthetic polynucleotide
agcagggauaacacacugcaaguga

SEQ ID NO: 654 - RNA, 25 nt, Artificial Sequence
  synthetic polynucleotide
gcagggauaacacacugcaagugga

SEQ ID NO: 655 - RNA, 25 nt, Artificial Sequence
  synthetic polynucleotide
cagggauaacacacugcaaguggaa

SEQ ID NO: 656 - RNA, 25 nt, Artificial Sequence
  synthetic polynucleotide
agggauaacacacugcaaguggaca

SEQ ID NO: 657 - RNA, 25 nt, Artificial Sequence
  synthetic polynucleotide
gggauaacacacugcaaguggacaa

SEQ ID NO: 658 - RNA, 25 nt, Artificial Sequence
  synthetic polynucleotide
gauaacacacugcaaguggacauca

SEQ ID NO: 659 - RNA, 25 nt, Artificial Sequence
  synthetic polynucleotide
auaacacacugcaaguggacaucaa

SEQ ID NO: 660 - RNA, 25 nt, Artificial Sequence
  synthetic polynucleotide
uaacacacugcaaguggacaucaaa

SEQ ID NO: 661 - RNA, 25 nt, Artificial Sequence
  synthetic polynucleotide
accuggccaccauucauggcaugaa

SEQ ID NO: 662 - RNA, 25 nt, Artificial Sequence
  synthetic polynucleotide
ccuggccaccauucauggcaugaaa

SEQ ID NO: 663 - RNA, 25 nt, Artificial Sequence
  synthetic polynucleotide
cuggccaccauucauggcaugaaca

SEQ ID NO: 664 - RNA, 25 nt, Artificial Sequence
  synthetic polynucleotide
cgagcccuggacaccaacuauugca

SEQ ID NO: 665 - RNA, 25 nt, Artificial Sequence
  synthetic polynucleotide
gagcccuggacaccaacuauugcua

SEQ ID NO: 666 - RNA, 25 nt, Artificial Sequence
  synthetic polynucleotide
agcccuggacaccaacuauugcuua

SEQ ID NO: 667 - RNA, 25 nt, Artificial Sequence
  synthetic polynucleotide
gcccuggacaccaacuauugcuuca

SEQ ID NO: 668 - RNA, 25 nt, Artificial Sequence
  synthetic polynucleotide
cccuggacaccaacuauugcuucaa

SEQ ID NO: 669 - RNA, 25 nt, Artificial Sequence
  synthetic polynucleotide
ccuggacaccaacuauugcuucaga

SEQ ID NO: 670 - RNA, 25 nt, Artificial Sequence
  synthetic polynucleotide
cuggacaccaacuauugcuucagca

SEQ ID NO: 671 - RNA, 25 nt, Artificial Sequence
  synthetic polynucleotide
uggacaccaacuauugcuucagcua

SEQ ID NO: 672 - RNA, 25 nt, Artificial Sequence
  synthetic polynucleotide
ggacaccaacuauugcuucagcuca

SEQ ID NO: 673 - RNA, 25 nt, Artificial Sequence
  synthetic polynucleotide
gacaccaacuauugcuucagcucca

SEQ ID NO: 674 - RNA, 25 nt, Artificial Sequence
  synthetic polynucleotide
acaccaacuauugcuucagcuccaa

SEQ ID NO: 675 - RNA, 25 nt, Artificial Sequence
  synthetic polynucleotide
gcgugcggcagcuguacauugacua

SEQ ID NO: 676 - RNA, 25 nt, Artificial Sequence
  synthetic polynucleotide
cgugcggcagcuguacauugacuua

SEQ ID NO: 677 - RNA, 25 nt, Artificial Sequence
  synthetic polynucleotide
gugcggcagcuguacauugacuuca

SEQ ID NO: 678 - RNA, 25 nt, Artificial Sequence
  synthetic polynucleotide
ugcggcagcuguacauugacuucca

SEQ ID NO: 679 - RNA, 25 nt, Artificial Sequence
  synthetic polynucleotide
cggcagcuguacauugacuuccgca

SEQ ID NO: 680 - RNA, 25 nt, Artificial Sequence
  synthetic polynucleotide
ggcagcuguacauugacuuccgcaa

SEQ ID NO: 681 - RNA, 25 nt, Artificial Sequence
  synthetic polynucleotide
gcagcuguacauugacuuccgcaaa

SEQ ID NO: 682 - RNA, 25 nt, Artificial Sequence
  synthetic polynucleotide
cagcuguacauugacuuccgcaaga

SEQ ID NO: 683 - RNA, 25 nt, Artificial Sequence
  synthetic polynucleotide
agcuguacauugacuuccgcaagga

SEQ ID NO: 684 - RNA, 25 nt, Artificial Sequence
  synthetic polynucleotide
ugccccuacauuuggagccuggaca

SEQ ID NO: 685 - RNA, 25 nt, Artificial Sequence
  synthetic polynucleotide
uccuggcccuguacaaccagcauaa

SEQ ID NO: 686 - RNA, 25 nt, Artificial Sequence
  synthetic polynucleotide
ccuggcccuguacaaccagcauaaa

SEQ ID NO: 687 - RNA, 25 nt, Artificial Sequence
  synthetic polynucleotide
cuggcccuguacaaccagcauaaca

SEQ ID NO: 688 - RNA, 25 nt, Artificial Sequence
  synthetic polynucleotide
agguggagcagcuguccaacaugaa

SEQ ID NO: 689 - RNA, 25 nt, Artificial Sequence
  synthetic polynucleotide
caugggggcuguauuuaaggacaca

SEQ ID NO: 690 - RNA, 25 nt, Artificial Sequence
  synthetic polynucleotide
ccuggggccccauuaaagauggaga

SEQ ID NO: 691 - RNA, 25 nt, Artificial Sequence
  synthetic polynucleotide
cuggggccccauuaaagauggagaa

SEQ ID NO: 692 - RNA, 25 nt, Artificial Sequence
  synthetic polynucleotide
uggggccccauuaaagauggagaga

SEQ ID NO: 693 - RNA, 25 nt, Artificial Sequence
  synthetic polynucleotide
ggggccccauuaaagauggagagaa

SEQ ID NO: 694 - RNA, 25 nt, Artificial Sequence
  synthetic polynucleotide
gggccccauuaaagauggagagaga

SEQ ID NO: 695 - RNA, 25 nt, Artificial Sequence
  synthetic polynucleotide
ggccccauuaaagauggagagagga

SEQ ID NO: 696 - RNA, 25 nt, Artificial Sequence
  synthetic polynucleotide
gccccauuaaagauggagagaggaa

SEQ ID NO: 697 - RNA, 25 nt, Artificial Sequence
  synthetic polynucleotide
ccccauuaaagauggagagaggaca

SEQ ID NO: 698 - RNA, 25 nt, Artificial Sequence
  synthetic polynucleotide
cccauuaaagauggagagaggacua

SEQ ID NO: 699 - RNA, 25 nt, Artificial Sequence
  synthetic polynucleotide
gaggacugcggaucucugugucaua

SEQ ID NO: 700 - RNA, 25 nt, Artificial Sequence
  synthetic polynucleotide
cuccugccugucugcacuauuccua

SEQ ID NO: 701 - RNA, 25 nt, Artificial Sequence
  synthetic polynucleotide
uccugccugucugcacuauuccuua

SEQ ID NO: 702 - RNA, 25 nt, Artificial Sequence
  synthetic polynucleotide
ccugccugucugcacuauuccuuua

SEQ ID NO: 703 - RNA, 25 nt, Artificial Sequence
  synthetic polynucleotide
cugccugucugcacuauuccuuuga

SEQ ID NO: 704 - RNA, 25 nt, Artificial Sequence
  synthetic polynucleotide
ugccugucugcacuauuccuuugca

SEQ ID NO: 705 - RNA, 25 nt, Artificial Sequence
  synthetic polynucleotide
caguggggaacacuacuguaguuaa

SEQ ID NO: 706 - RNA, 25 nt, Artificial Sequence
  synthetic polynucleotide
aguggggaacacuacuguaguuaga

SEQ ID NO: 707 - RNA, 25 nt, Artificial Sequence
  synthetic polynucleotide
guggggaacacuacuguaguuagaa

SEQ ID NO: 708 - RNA, 25 nt, Artificial Sequence
  synthetic polynucleotide
uggggaacacuacuguaguuagaua

SEQ ID NO: 709 - RNA, 25 nt, Artificial Sequence
  synthetic polynucleotide
uuuuaaaaaaugcacuacugugugc

SEQ ID NO: 710 - RNA, 25 nt, Artificial Sequence
  synthetic polynucleotide
uaaaaaaugcacuacugugugcuga

SEQ ID NO: 711 - RNA, 25 nt, Artificial Sequence
  synthetic polynucleotide
gcagcacacucgauauggaccaguu

SEQ ID NO: 712 - RNA, 25 nt, Artificial Sequence
  synthetic polynucleotide
agcacacucgauauggaccaguuca

SEQ ID NO: 713 - RNA, 25 nt, Artificial Sequence
  synthetic polynucleotide
gcacacucgauauggaccaguucau

SEQ ID NO: 714 - RNA, 25 nt, Artificial Sequence
  synthetic polynucleotide
cacacucgauauggaccaguucaug

SEQ ID NO: 715 - RNA, 25 nt, Artificial Sequence
  synthetic polynucleotide
acacucgauauggaccaguucaugc

SEQ ID NO: 716 - RNA, 25 nt, Artificial Sequence
  synthetic polynucleotide
cacucgauauggaccaguucaugcg

SEQ ID NO: 717 - RNA, 25 nt, Artificial Sequence
  synthetic polynucleotide
uccccccggaggugauuuccaucua

SEQ ID NO: 718 - RNA, 25 nt, Artificial Sequence
  synthetic polynucleotide
ccccccggaggugauuuccaucuac

SEQ ID NO: 719 - RNA, 25 nt, Artificial Sequence
  synthetic polynucleotide
cccggaggugauuuccaucuacaac

SEQ ID NO: 720 - RNA, 25 nt, Artificial Sequence
  synthetic polynucleotide
cggaggugauuuccaucuacaacag

SEQ ID NO: 721 - RNA, 25 nt, Artificial Sequence
  synthetic polynucleotide
gaggugauuuccaucuacaacagca

SEQ ID NO: 722 - RNA, 25 nt, Artificial Sequence
  synthetic polynucleotide
acuacgccaaggagguuuacaaaau

SEQ ID NO: 723 - RNA, 25 nt, Artificial Sequence
  synthetic polynucleotide
gagguuuacaaaauagacaugccgc

SEQ ID NO: 724 - RNA, 25 nt, Artificial Sequence
  synthetic polynucleotide
uucuacagacccuacuucagaauug

SEQ ID NO: 725 - RNA, 25 nt, Artificial Sequence
  synthetic polynucleotide
ucuacagacccuacuucagaauugu

SEQ ID NO: 726 - RNA, 25 nt, Artificial Sequence
  synthetic polynucleotide
cuacagacccuacuucagaauuguu

SEQ ID NO: 727 - RNA, 25 nt, Artificial Sequence
  synthetic polynucleotide
uuguucgauuugacgucucagcaau

SEQ ID NO: 728 - RNA, 25 nt, Artificial Sequence
  synthetic polynucleotide
uguucgauuugacgucucagcaaug

SEQ ID NO: 729 - RNA, 25 nt, Artificial Sequence
  synthetic polynucleotide
guucgauuugacgucucagcaaugg

SEQ ID NO: 730 - RNA, 25 nt, Artificial Sequence
  synthetic polynucleotide
uucgauuugacgucucagcaaugga

SEQ ID NO: 731 - RNA, 25 nt, Artificial Sequence
  synthetic polynucleotide
ucucagcaauggagaagaaugcuuc

SEQ ID NO: 732 - RNA, 25 nt, Artificial Sequence
  synthetic polynucleotide
cucagcaauggagaagaaugcuucc

SEQ ID NO: 733 - RNA, 25 nt, Artificial Sequence
  synthetic polynucleotide
cagcaauggagaagaaugcuuccaa

SEQ ID NO: 734 - RNA, 25 nt, Artificial Sequence
  synthetic polynucleotide
augcuuccaauuuggugaaagcaga

SEQ ID NO: 735 - RNA, 25 nt, Artificial Sequence
  synthetic polynucleotide
ugcuuccaauuuggugaaagcagag

SEQ ID NO: 736 - RNA, 25 nt, Artificial Sequence
  synthetic polynucleotide
cuuccaauuuggugaaagcagaguu

SEQ ID NO: 737 - RNA, 25 nt, Artificial Sequence
  synthetic polynucleotide
ugaaagcagaguucagagucuuucg

SEQ ID NO: 738 - RNA, 25 nt, Artificial Sequence
  synthetic polynucleotide
gaguucagagucuuucguuugcaga

SEQ ID NO: 739 - RNA, 25 nt, Artificial Sequence
  synthetic polynucleotide
ccagagugccugaacaacggauuga

SEQ ID NO: 740 - RNA, 25 nt, Artificial Sequence
  synthetic polynucleotide
gugccugaacaacggauugagcuau

SEQ ID NO: 741 - RNA, 25 nt, Artificial Sequence
  synthetic polynucleotide
ugccugaacaacggauugagcuaua

SEQ ID NO: 742 - RNA, 25 nt, Artificial Sequence
  synthetic polynucleotide
cugaacaacggauugagcuauauca

SEQ ID NO: 743 - RNA, 25 nt, Artificial Sequence
  synthetic polynucleotide
ugaacaacggauugagcuauaucag

SEQ ID NO: 744 - RNA, 25 nt, Artificial Sequence
  synthetic polynucleotide
gaacaacggauugagcuauaucaga

SEQ ID NO: 745 - RNA, 25 nt, Artificial Sequence
  synthetic polynucleotide
caacggauugagcuauaucagauuc

SEQ ID NO: 746 - RNA, 25 nt, Artificial Sequence
  synthetic polynucleotide
gauugagcuauaucagauucucaag

SEQ ID NO: 747 - RNA, 25 nt, Artificial Sequence
  synthetic polynucleotide
auugagcuauaucagauucucaagu

SEQ ID NO: 748 - RNA, 25 nt, Artificial Sequence
  synthetic polynucleotide
uugagcuauaucagauucucaaguc

SEQ ID NO: 749 - RNA, 25 nt, Artificial Sequence
  synthetic polynucleotide
auaucagauucucaaguccaaagau

SEQ ID NO: 750 - RNA, 25 nt, Artificial Sequence
  synthetic polynucleotide
ucucaaguccaaagauuuaacaucu

SEQ ID NO: 751 - RNA, 25 nt, Artificial Sequence
  synthetic polynucleotide
caaguccaaagauuuaacaucucca

SEQ ID NO: 752 - RNA, 25 nt, Artificial Sequence
  synthetic polynucleotide
ccagcgcuacaucgacagcaaaguu

SEQ ID NO: 753 - RNA, 25 nt, Artificial Sequence
  synthetic polynucleotide
agcgcuacaucgacagcaaaguugu

SEQ ID NO: 754 - RNA, 25 nt, Artificial Sequence
  synthetic polynucleotide
gcgcuacaucgacagcaaaguugug

SEQ ID NO: 755 - RNA, 25 nt, Artificial Sequence
  synthetic polynucleotide
cuacaucgacagcaaaguugugaaa

SEQ ID NO: 756 - RNA, 25 nt, Artificial Sequence
  synthetic polynucleotide
cgaauggcucuccuucgauguaacu

SEQ ID NO: 757 - RNA, 25 nt, Artificial Sequence
  synthetic polynucleotide
acugaugcuguucaugaauggcuuc

SEQ ID NO: 758 - RNA, 25 nt, Artificial Sequence
  synthetic polynucleotide
uguucaugaauggcuucaccauaaa

SEQ ID NO: 759 - RNA, 25 nt, Artificial Sequence
  synthetic polynucleotide
guucaugaauggcuucaccauaaag

SEQ ID NO: 760 - RNA, 25 nt, Artificial Sequence
  synthetic polynucleotide
uucaugaauggcuucaccauaaaga

SEQ ID NO: 761 - RNA, 25 nt, Artificial Sequence
  synthetic polynucleotide
ucaugaauggcuucaccauaaagac

SEQ ID NO: 762 - RNA, 25 nt, Artificial Sequence
  synthetic polynucleotide
caugaauggcuucaccauaaagaca

SEQ ID NO: 763 - RNA, 25 nt, Artificial Sequence
  synthetic polynucleotide
gaauggcuucaccauaaagacagga

SEQ ID NO: 764 - RNA, 25 nt, Artificial Sequence
  synthetic polynucleotide
ggauuuaaaauaagcuuacacuguc

SEQ ID NO: 765 - RNA, 25 nt, Artificial Sequence
  synthetic polynucleotide
gauuuaaaauaagcuuacacugucc

SEQ ID NO: 766 - RNA, 25 nt, Artificial Sequence
  synthetic polynucleotide
acacugucccugcugcacuuuugua

SEQ ID NO: 767 - RNA, 25 nt, Artificial Sequence
  synthetic polynucleotide
cugucccugcugcacuuuuguacca

SEQ ID NO: 768 - RNA, 25 nt, Artificial Sequence
  synthetic polynucleotide
gucccugcugcacuuuuguaccauc

SEQ ID NO: 769 - RNA, 25 nt, Artificial Sequence
  synthetic polynucleotide
ucccugcugcacuuuuguaccaucu

SEQ ID NO: 770 - RNA, 25 nt, Artificial Sequence
  synthetic polynucleotide
cccugcugcacuuuuguaccaucua

SEQ ID NO: 771 - RNA, 25 nt, Artificial Sequence
  synthetic polynucleotide
uuacaucaucccaaauaaaagugaa

SEQ ID NO: 772 - RNA, 25 nt, Artificial Sequence
  synthetic polynucleotide
uacaucaucccaaauaaaagugaag

SEQ ID NO: 773 - RNA, 25 nt, Artificial Sequence
  synthetic polynucleotide
agugaagaacuagaagcaagauuug

SEQ ID NO: 774 - RNA, 25 nt, Artificial Sequence
  synthetic polynucleotide
ugaagaacuagaagcaagauuugca

SEQ ID NO: 775 - RNA, 25 nt, Artificial Sequence
  synthetic polynucleotide
aagaacuagaagcaagauuugcagg

SEQ ID NO: 776 - RNA, 25 nt, Artificial Sequence
  synthetic polynucleotide
agaacuagaagcaagauuugcaggu

SEQ ID NO: 777 - RNA, 25 nt, Artificial Sequence
  synthetic polynucleotide
gaacuagaagcaagauuugcaggua

SEQ ID NO: 778 - RNA, 25 nt, Artificial Sequence
  synthetic polynucleotide
uagaagcaagauuugcagguauuga

SEQ ID NO: 779 - RNA, 25 nt, Artificial Sequence
  synthetic polynucleotide
agaagcaagauuugcagguauugau

SEQ ID NO: 780 - RNA, 25 nt, Artificial Sequence
  synthetic polynucleotide
gaagcaagauuugcagguauugaug

SEQ ID NO: 781 - RNA, 25 nt, Artificial Sequence
  synthetic polynucleotide
aagcaagauuugcagguauugaugg

SEQ ID NO: 782 - RNA, 25 nt, Artificial Sequence
  synthetic polynucleotide
agcaagauuugcagguauugauggc

SEQ ID NO: 783 - RNA, 25 nt, Artificial Sequence
  synthetic polynucleotide
gcaagauuugcagguauugauggca

SEQ ID NO: 784 - RNA, 25 nt, Artificial Sequence
  synthetic polynucleotide
caagauuugcagguauugauggcac

SEQ ID NO: 785 - RNA, 25 nt, Artificial Sequence
  synthetic polynucleotide
agguauugauggcaccuccacauau

SEQ ID NO: 786 - RNA, 25 nt, Artificial Sequence
  synthetic polynucleotide
gauggcaccuccacauauaccagug

SEQ ID NO: 787 - RNA, 25 nt, Artificial Sequence
  synthetic polynucleotide
ggcaccuccacauauaccaguggug

SEQ ID NO: 788 - RNA, 25 nt, Artificial Sequence
  synthetic polynucleotide
ccuccacauauaccaguggugauca

SEQ ID NO: 789 - RNA, 25 nt, Artificial Sequence
  synthetic polynucleotide
cuccacauauaccaguggugaucag

SEQ ID NO: 790 - RNA, 25 nt, Artificial Sequence
  synthetic polynucleotide
uccacauauaccaguggugaucaga

SEQ ID NO: 791 - RNA, 25 nt, Artificial Sequence
  synthetic polynucleotide
auauaccaguggugaucagaaaacu

SEQ ID NO: 792 - RNA, 25 nt, Artificial Sequence
  synthetic polynucleotide
uauaccaguggugaucagaaaacua

SEQ ID NO: 793 - RNA, 25 nt, Artificial Sequence
  synthetic polynucleotide
uaccaguggugaucagaaaacuaua

SEQ ID NO: 794 - RNA, 25 nt, Artificial Sequence
  synthetic polynucleotide
uggugaucagaaaacuauaaagucc

SEQ ID NO: 795 - RNA, 25 nt, Artificial Sequence
  synthetic polynucleotide
ggugaucagaaaacuauaaagucca

SEQ ID NO: 796 - RNA, 25 nt, Artificial Sequence
  synthetic polynucleotide
ugaucagaaaacuauaaaguccacu

SEQ ID NO: 797 - RNA, 25 nt, Artificial Sequence
  synthetic polynucleotide
aucagaaaacuauaaaguccacuag

SEQ ID NO: 798 - RNA, 25 nt, Artificial Sequence
  synthetic polynucleotide
ucagaaaacuauaaaguccacuagg

SEQ ID NO: 799 - RNA, 25 nt, Artificial Sequence
  synthetic polynucleotide
accccacaucuccugcuaauguuau

SEQ ID NO: 800 - RNA, 25 nt, Artificial Sequence
  synthetic polynucleotide
ccccacaucuccugcuaauguuauu

SEQ ID NO: 801 - RNA, 25 nt, Artificial Sequence
  synthetic polynucleotide
cacaucuccugcuaauguuauugcc

SEQ ID NO: 802 - RNA, 25 nt, Artificial Sequence
  synthetic polynucleotide
uaauguuauugcccuccuacagacu

SEQ ID NO: 803 - RNA, 25 nt, Artificial Sequence
  synthetic polynucleotide
aauguuauugcccuccuacagacuu

SEQ ID NO: 804 - RNA, 25 nt, Artificial Sequence
  synthetic polynucleotide
auugcccuccuacagacuugaguca

SEQ ID NO: 805 - RNA, 25 nt, Artificial Sequence
  synthetic polynucleotide
gcuuuggaugcggccuauugcuuua

SEQ ID NO: 806 - RNA, 25 nt, Artificial Sequence
  synthetic polynucleotide
uuuggaugcggccuauugcuuuaga

SEQ ID NO: 807 - RNA, 25 nt, Artificial Sequence
  synthetic polynucleotide
uuggaugcggccuauugcuuuagaa

SEQ ID NO: 808 - RNA, 25 nt, Artificial Sequence
  synthetic polynucleotide
ggaugcggccuauugcuuuagaaau

SEQ ID NO: 809 - RNA, 25 nt, Artificial Sequence
  synthetic polynucleotide
augcggccuauugcuuuagaaaugu

SEQ ID NO: 810 - RNA, 25 nt, Artificial Sequence
  synthetic polynucleotide
ugcggccuauugcuuuagaaaugug

SEQ ID NO: 811 - RNA, 25 nt, Artificial Sequence
  synthetic polynucleotide
gcggccuauugcuuuagaaaugugc

SEQ ID NO: 812 - RNA, 25 nt, Artificial Sequence
  synthetic polynucleotide
cggccuauugcuuuagaaaugugca

SEQ ID NO: 813 - RNA, 25 nt, Artificial Sequence
  synthetic polynucleotide
gccuauugcuuuagaaaugugcagg

SEQ ID NO: 814 - RNA, 25 nt, Artificial Sequence
  synthetic polynucleotide
ccuauugcuuuagaaaugugcagga

SEQ ID NO: 815 - RNA, 25 nt, Artificial Sequence
  synthetic polynucleotide
cuauugcuuuagaaaugugcaggau

SEQ ID NO: 816 - RNA, 25 nt, Artificial Sequence
  synthetic polynucleotide
uauugcuuuagaaaugugcaggaua

SEQ ID NO: 817 - RNA, 25 nt, Artificial Sequence
  synthetic polynucleotide
auugcuuuagaaaugugcaggauaa

SEQ ID NO: 818 - RNA, 25 nt, Artificial Sequence
  synthetic polynucleotide
uugcuuuagaaaugugcaggauaau

SEQ ID NO: 819 - RNA, 25 nt, Artificial Sequence
  synthetic polynucleotide
ugcuuuagaaaugugcaggauaauu

SEQ ID NO: 820 - RNA, 25 nt, Artificial Sequence
  synthetic polynucleotide
cuuuagaaaugugcaggauaauugc

SEQ ID NO: 821 - RNA, 25 nt, Artificial Sequence
  synthetic polynucleotide
uuuagaaaugugcaggauaauugcu

SEQ ID NO: 822 - RNA, 25 nt, Artificial Sequence
  synthetic polynucleotide
uuagaaaugugcaggauaauugcug

SEQ ID NO: 823 - RNA, 25 nt, Artificial Sequence
  synthetic polynucleotide
augugcaggauaauugcugccuacg

SEQ ID NO: 824 - RNA, 25 nt, Artificial Sequence
  synthetic polynucleotide
ggguacaaugccaacuucugugcug

SEQ ID NO: 825 - RNA, 25 nt, Artificial Sequence
  synthetic polynucleotide
aaugccaacuucugugcuggagcau

SEQ ID NO: 826 - RNA, 25 nt, Artificial Sequence
  synthetic polynucleotide
gcuggagcaugcccguauuuaugga

SEQ ID NO: 827 - RNA, 25 nt, Artificial Sequence
  synthetic polynucleotide
cuggagcaugcccguauuuauggag

SEQ ID NO: 828 - RNA, 25 nt, Artificial Sequence
  synthetic polynucleotide
gagcaugcccguauuuauggaguuc

SEQ ID NO: 829 - RNA, 25 nt, Artificial Sequence
  synthetic polynucleotide
agcaugcccguauuuauggaguuca

SEQ ID NO: 830 - RNA, 25 nt, Artificial Sequence
  synthetic polynucleotide
gcaugcccguauuuauggaguucag

SEQ ID NO: 831 - RNA, 25 nt, Artificial Sequence
  synthetic polynucleotide
caugcccguauuuauggaguucaga

SEQ ID NO: 832 - RNA, 25 nt, Artificial Sequence
  synthetic polynucleotide
guauuuauggaguucagacacucag

SEQ ID NO: 833 - RNA, 25 nt, Artificial Sequence
  synthetic polynucleotide
uuauggaguucagacacucagcaca

SEQ ID NO: 834 - RNA, 25 nt, Artificial Sequence
  synthetic polynucleotide
aaccauucucuacuacauuggcaaa

SEQ ID NO: 835 - RNA, 25 nt, Artificial Sequence
  synthetic polynucleotide
uuggcaaaacacccaagauugaaca

SEQ ID NO: 836 - RNA, 25 nt, Artificial Sequence
  synthetic polynucleotide
uggcaaaacacccaagauugaacag

SEQ ID NO: 837 - RNA, 25 nt, Artificial Sequence
  synthetic polynucleotide
uugcaaaugcagcuaaaauucuugg

SEQ ID NO: 838 - RNA, 25 nt, Artificial Sequence
  synthetic polynucleotide
caaugaugaugauaaugaugaugac

SEQ ID NO: 839 - RNA, 25 nt, Artificial Sequence
  synthetic polynucleotide
augaugaugauaaugaugaugacga

SEQ ID NO: 840 - RNA, 25 nt, Artificial Sequence
  synthetic polynucleotide
ugaugaugauaaugaugaugacgac

SEQ ID NO: 841 - RNA, 25 nt, Artificial Sequence
  synthetic polynucleotide
augaugauaaugaugaugacgacga

SEQ ID NO: 842 - RNA, 25 nt, Artificial Sequence
  synthetic polynucleotide
ugaugauaaugaugaugacgacgac

SEQ ID NO: 843 - RNA, 25 nt, Artificial Sequence
  synthetic polynucleotide
augauaaugaugaugacgacgacaa

SEQ ID NO: 844 - RNA, 25 nt, Artificial Sequence
  synthetic polynucleotide
ugauaaugaugaugacgacgacaac

SEQ ID NO: 845 - RNA, 25 nt, Artificial Sequence
  synthetic polynucleotide
auaaugaugaugacgacgacaacga

SEQ ID NO: 846 - RNA, 25 nt, Artificial Sequence
  synthetic polynucleotide
uaaugaugaugacgacgacaacgau

SEQ ID NO: 847 - RNA, 25 nt, Artificial Sequence
  synthetic polynucleotide
augaugaugacgacgacaacgauga

SEQ ID NO: 848 - RNA, 25 nt, Artificial Sequence
  synthetic polynucleotide
ugaugaugacgacgacaacgaugau

SEQ ID NO: 849 - RNA, 25 nt, Artificial Sequence
  synthetic polynucleotide
gaugacgacgacaacgaugaugcuu

SEQ ID NO: 850 - RNA, 25 nt, Artificial Sequence
  synthetic polynucleotide
gacgacaacgaugaugcuuguaaca

SEQ ID NO: 851 - RNA, 25 nt, Artificial Sequence
  synthetic polynucleotide
acgacaacgaugaugcuuguaacaa

SEQ ID NO: 852 - RNA, 25 nt, Artificial Sequence
  synthetic polynucleotide
uaacaagaaaacauaagagagccuu

SEQ ID NO: 853 - RNA, 25 nt, Artificial Sequence
  synthetic polynucleotide
aacaagaaaacauaagagagccuug

SEQ ID NO: 854 - RNA, 25 nt, Artificial Sequence
  synthetic polynucleotide
acaagaaaacauaagagagccuugg

SEQ ID NO: 855 - RNA, 25 nt, Artificial Sequence
  synthetic polynucleotide
aaaacauaagagagccuugguucau

SEQ ID NO: 856 - RNA, 25 nt, Artificial Sequence
  synthetic polynucleotide
aaacauaagagagccuugguucauc

SEQ ID NO: 857 - RNA, 25 nt, Artificial Sequence
  synthetic polynucleotide
aagagagccuugguucaucaguguu

SEQ ID NO: 858 - RNA, 25 nt, Artificial Sequence
  synthetic polynucleotide
gagagccuugguucaucaguguuaa

SEQ ID NO: 859 - RNA, 25 nt, Artificial Sequence
  synthetic polynucleotide
gagccuugguucaucaguguuaaaa

SEQ ID NO: 860 - RNA, 25 nt, Artificial Sequence
  synthetic polynucleotide
uuuuugaaaaggcgguacuaguuca

SEQ ID NO: 861 - RNA, 25 nt, Artificial Sequence
  synthetic polynucleotide
aaaaggcgguacuaguucagacacu

SEQ ID NO: 862 - RNA, 25 nt, Artificial Sequence
  synthetic polynucleotide
aaaggcgguacuaguucagacacuu

SEQ ID NO: 863 - RNA, 25 nt, Artificial Sequence
  synthetic polynucleotide
acacuuuggaaguuuguguucuguu

SEQ ID NO: 864 - RNA, 25 nt, Artificial Sequence
  synthetic polynucleotide
cacuuuggaaguuuguguucuguuu

SEQ ID NO: 865 - RNA, 25 nt, Artificial Sequence
  synthetic polynucleotide
uuuggaaguuuguguucuguuuguu

SEQ ID NO: 866 - RNA, 25 nt, Artificial Sequence
  synthetic polynucleotide
aaguuuguguucuguuuguuaaaac

SEQ ID NO: 867 - RNA, 25 nt, Artificial Sequence
  synthetic polynucleotide
guuuguguucuguuuguuaaaacug

SEQ ID NO: 868 - RNA, 25 nt, Artificial Sequence
  synthetic polynucleotide
uuuguguucuguuuguuaaaacugg

SEQ ID NO: 869 - RNA, 25 nt, Artificial Sequence
  synthetic polynucleotide
uuguguucuguuuguuaaaacuggc

SEQ ID NO: 870 - RNA, 25 nt, Artificial Sequence
  synthetic polynucleotide
uguguucuguuuguuaaaacuggca

SEQ ID NO: 871 - RNA, 25 nt, Artificial Sequence
  synthetic polynucleotide
uguucuguuuguuaaaacuggcauc

SEQ ID NO: 872 - RNA, 25 nt, Artificial Sequence
  synthetic polynucleotide
guucuguuuguuaaaacuggcaucu

SEQ ID NO: 873 - RNA, 25 nt, Artificial Sequence
  synthetic polynucleotide
uucuguuuguuaaaacuggcaucug

SEQ ID NO: 874 - RNA, 25 nt, Artificial Sequence
  synthetic polynucleotide
ucuguuuguuaaaacuggcaucuga

SEQ ID NO: 875 - RNA, 25 nt, Artificial Sequence
  synthetic polynucleotide
cuguuuguuaaaacuggcaucugac

SEQ ID NO: 876 - RNA, 25 nt, Artificial Sequence
  synthetic polynucleotide
aguugaaggccuuauucuacauuuc

SEQ ID NO: 877 - RNA, 25 nt, Artificial Sequence
  synthetic polynucleotide
guugaaggccuuauucuacauuuca

SEQ ID NO: 878 - RNA, 25 nt, Artificial Sequence
  synthetic polynucleotide
acauuucaccuacuuuguaagugag

SEQ ID NO: 879 - RNA, 25 nt, Artificial Sequence
  synthetic polynucleotide
aauaaacacuggaagaauuuauuag

SEQ ID NO: 880 - RNA, 25 nt, Artificial Sequence
  synthetic polynucleotide
uaaacacuggaagaauuuauuagug

SEQ ID NO: 881 - RNA, 25 nt, Artificial Sequence
  synthetic polynucleotide
auuaugugaacaacgacaacaacaa

SEQ ID NO: 882 - RNA, 25 nt, Artificial Sequence
  synthetic polynucleotide
uuaugugaacaacgacaacaacaac

SEQ ID NO: 883 - RNA, 25 nt, Artificial Sequence
  synthetic polynucleotide
uaugugaacaacgacaacaacaaca

SEQ ID NO: 884 - RNA, 25 nt, Artificial Sequence
  synthetic polynucleotide
augugaacaacgacaacaacaacaa

SEQ ID NO: 885 - RNA, 25 nt, Artificial Sequence
  synthetic polynucleotide
ugugaacaacgacaacaacaacaac

SEQ ID NO: 886 - RNA, 25 nt, Artificial Sequence
  synthetic polynucleotide
ugaacaacgacaacaacaacaacaa

SEQ ID NO: 887 - RNA, 25 nt, Artificial Sequence
  synthetic polynucleotide
gaacaacgacaacaacaacaacaac

SEQ ID NO: 888 - RNA, 25 nt, Artificial Sequence
  synthetic polynucleotide
acaacgacaacaacaacaacaacaa

SEQ ID NO: 889 - RNA, 25 nt, Artificial Sequence
  synthetic polynucleotide
caacgacaacaacaacaacaacaac

SEQ ID NO: 890 - RNA, 25 nt, Artificial Sequence
  synthetic polynucleotide
cgacaacaacaacaacaacaacaaa

SEQ ID NO: 891 - RNA, 25 nt, Artificial Sequence
  synthetic polynucleotide
gacaacaacaacaacaacaacaaac

SEQ ID NO: 892 - RNA, 25 nt, Artificial Sequence
  synthetic polynucleotide
caacaacaacaacaacaaacaggaa

SEQ ID NO: 893 - RNA, 25 nt, Artificial Sequence
  synthetic polynucleotide
aacaacaacaacaacaaacaggaaa

SEQ ID NO: 894 - RNA, 25 nt, Artificial Sequence
  synthetic polynucleotide
cuugauuuuucuguauugcuaugca

SEQ ID NO: 895 - RNA, 25 nt, Artificial Sequence
  synthetic polynucleotide
acucuuagaguuaacagugaguuau

SEQ ID NO: 896 - RNA, 25 nt, Artificial Sequence
  synthetic polynucleotide
uuaacagugaguuauuuauugugug

SEQ ID NO: 897 - RNA, 25 nt, Artificial Sequence
  synthetic polynucleotide
uacuauauaaugaacguuucauugc

SEQ ID NO: 898 - RNA, 25 nt, Artificial Sequence
  synthetic polynucleotide
acuauauaaugaacguuucauugcc

SEQ ID NO: 899 - RNA, 25 nt, Artificial Sequence
  synthetic polynucleotide
acguuucauugcccuuggaaaauaa

SEQ ID NO: 900 - RNA, 25 nt, Artificial Sequence
  synthetic polynucleotide
uucauugcccuuggaaaauaaaaca

SEQ ID NO: 901 - RNA, 25 nt, Artificial Sequence
  synthetic polynucleotide
ugcccuuggaaaauaaaacaggugu

SEQ ID NO: 902 - RNA, 25 nt, Artificial Sequence
  synthetic polynucleotide
uaaaguggagaccaaauacuuugcc

SEQ ID NO: 903 - RNA, 25 nt, Artificial Sequence
  synthetic polynucleotide
aaaguggagaccaaauacuuugcca

SEQ ID NO: 904 - RNA, 25 nt, Artificial Sequence
  synthetic polynucleotide
gagaccaaauacuuugccagaaacu

SEQ ID NO: 905 - RNA, 25 nt, Artificial Sequence
  synthetic polynucleotide
agaccaaauacuuugccagaaacuc

SEQ ID NO: 906 - RNA, 25 nt, Artificial Sequence
  synthetic polynucleotide
gaccaaauacuuugccagaaacuca

SEQ ID NO: 907 - RNA, 25 nt, Artificial Sequence
  synthetic polynucleotide
accaaauacuuugccagaaacucau

SEQ ID NO: 908 - RNA, 25 nt, Artificial Sequence
  synthetic polynucleotide
ccaaauacuuugccagaaacucaug

SEQ ID NO: 909 - RNA, 25 nt, Artificial Sequence
  synthetic polynucleotide
caaauacuuugccagaaacucaugg

SEQ ID NO: 910 - RNA, 25 nt, Artificial Sequence
  synthetic polynucleotide
cuuugccagaaacucauggauggcu

SEQ ID NO: 911 - RNA, 25 nt, Artificial Sequence
  synthetic polynucleotide
uuugccagaaacucauggauggcuu

SEQ ID NO: 912 - RNA, 25 nt, Artificial Sequence
  synthetic polynucleotide
ugccagaaacucauggauggcuuaa

SEQ ID NO: 913 - RNA, 25 nt, Artificial Sequence
  synthetic polynucleotide
gccagaaacucauggauggcuuaag

SEQ ID NO: 914 - RNA, 25 nt, Artificial Sequence
  synthetic polynucleotide
ccagaaacucauggauggcuuaagg

SEQ ID NO: 915 - RNA, 25 nt, Artificial Sequence
  synthetic polynucleotide
cagaaacucauggauggcuuaagga

SEQ ID NO: 916 - RNA, 25 nt, Artificial Sequence
  synthetic polynucleotide
agaaacucauggauggcuuaaggaa

SEQ ID NO: 917 - RNA, 25 nt, Artificial Sequence
  synthetic polynucleotide
aacucauggauggcuuaaggaacuu

SEQ ID NO: 918 - RNA, 25 nt, Artificial Sequence
  synthetic polynucleotide
cuuaaggaacuugaacucaaacgag

SEQ ID NO: 919 - RNA, 25 nt, Artificial Sequence
  synthetic polynucleotide
uuaaggaacuugaacucaaacgagc

SEQ ID NO: 920 - RNA, 25 nt, Artificial Sequence
  synthetic polynucleotide
uaaggaacuugaacucaaacgagcc

SEQ ID NO: 921 - RNA, 25 nt, Artificial Sequence
  synthetic polynucleotide
aaggaacuugaacucaaacgagcca

SEQ ID NO: 922 - RNA, 25 nt, Artificial Sequence
  synthetic polynucleotide
aggaacuugaacucaaacgagccag

SEQ ID NO: 923 - RNA, 25 nt, Artificial Sequence
  synthetic polynucleotide
gaacuugaacucaaacgagccagaa

SEQ ID NO: 924 - RNA, 25 nt, Artificial Sequence
  synthetic polynucleotide
aagugaguuauuauaugaccgagaa

SEQ ID NO: 925 - RNA, 25 nt, Artificial Sequence
  synthetic polynucleotide
uguuauguaucagcugccuaaggaa

SEQ ID NO: 926 - RNA, 25 nt, Artificial Sequence
  synthetic polynucleotide
uuuaauuguaaaugguucuuuguca

SEQ ID NO: 927 - RNA, 25 nt, Artificial Sequence
  synthetic polynucleotide
uuaauuguaaaugguucuuugucag

SEQ ID NO: 928 - RNA, 25 nt, Artificial Sequence
  synthetic polynucleotide
uaauuguaaaugguucuuugucagu

SEQ ID NO: 929 - RNA, 25 nt, Artificial Sequence
  synthetic polynucleotide
auuguaaaugguucuuugucaguuu

SEQ ID NO: 930 - RNA, 25 nt, Artificial Sequence
  synthetic polynucleotide
guaaaugguucuuugucaguuuagu

SEQ ID NO: 931 - RNA, 25 nt, Artificial Sequence
  synthetic polynucleotide
uuugucaguuuaguaaaccagugaa

SEQ ID NO: 932 - RNA, 25 nt, Artificial Sequence
  synthetic polynucleotide
ucaguuuaguaaaccagugaaaugu

SEQ ID NO: 933 - RNA, 25 nt, Artificial Sequence
  synthetic polynucleotide
guuuaguaaaccagugaaauguuga

SEQ ID NO: 934 - RNA, 25 nt, Artificial Sequence
  synthetic polynucleotide
aaauguuuugacauguacuggucaa

SEQ ID NO: 935 - RNA, 25 nt, Artificial Sequence
  synthetic polynucleotide
uggauauagaagccagcauaauuga

SEQ ID NO: 936 - RNA, 25 nt, Artificial Sequence
  synthetic polynucleotide
ggauauagaagccagcauaauugaa

SEQ ID NO: 937 - RNA, 25 nt, Artificial Sequence
  synthetic polynucleotide
gauauagaagccagcauaauugaaa

SEQ ID NO: 938 - RNA, 25 nt, Artificial Sequence
  synthetic polynucleotide
uagaagccagcauaauugaaaacac

SEQ ID NO: 939 - RNA, 25 nt, Artificial Sequence
  synthetic polynucleotide
agaagccagcauaauugaaaacaca

SEQ ID NO: 940 - RNA, 25 nt, Artificial Sequence
  synthetic polynucleotide
aagccagcauaauugaaaacacauc

SEQ ID NO: 941 - RNA, 25 nt, Artificial Sequence
  synthetic polynucleotide
acaaauguauguuucuuuuagcugg

SEQ ID NO: 942 - RNA, 25 nt, Artificial Sequence
  synthetic polynucleotide
caaauguauguuucuuuuagcuggc

SEQ ID NO: 943 - RNA, 25 nt, Artificial Sequence
  synthetic polynucleotide
uguauguuucuuuuagcuggccagu

SEQ ID NO: 944 - RNA, 25 nt, Artificial Sequence
  synthetic polynucleotide
uauguuucuuuuagcuggccaguac

SEQ ID NO: 945 - RNA, 25 nt, Artificial Sequence
  synthetic polynucleotide
auguuucuuuuagcuggccaguacu

SEQ ID NO: 946 - RNA, 25 nt, Artificial Sequence
  synthetic polynucleotide
guuucuuuuagcuggccaguacuuu

SEQ ID NO: 947 - RNA, 25 nt, Artificial Sequence
  synthetic polynucleotide
ucuuuuagcuggccaguacuuuuga

SEQ ID NO: 948 - RNA, 25 nt, Artificial Sequence
  synthetic polynucleotide
uuagcuggccaguacuuuugaguaa

SEQ ID NO: 949 - RNA, 25 nt, Artificial Sequence
  synthetic polynucleotide
agcuggccaguacuuuugaguaaag

SEQ ID NO: 950 - RNA, 25 nt, Artificial Sequence
  synthetic polynucleotide
gcuggccaguacuuuugaguaaagc

SEQ ID NO: 951 - RNA, 25 nt, Artificial Sequence
  synthetic polynucleotide
cuggccaguacuuuugaguaaagcc

SEQ ID NO: 952 - RNA, 25 nt, Artificial Sequence
  synthetic polynucleotide
gccccuauaguuugacuugcacuac

SEQ ID NO: 953 - RNA, 25 nt, Artificial Sequence
  synthetic polynucleotide
cccuauaguuugacuugcacuacaa

SEQ ID NO: 954 - RNA, 25 nt, Artificial Sequence
  synthetic polynucleotide
ccuauaguuugacuugcacuacaaa

SEQ ID NO: 955 - RNA, 25 nt, Artificial Sequence
  synthetic polynucleotide
cuauaguuugacuugcacuacaaau

SEQ ID NO: 956 - RNA, 25 nt, Artificial Sequence
  synthetic polynucleotide
uauaguuugacuugcacuacaaaug

SEQ ID NO: 957 - RNA, 25 nt, Artificial Sequence
  synthetic polynucleotide
uucauuauuaugacauaagcuaccu

SEQ ID NO: 958 - RNA, 25 nt, Artificial Sequence
  synthetic polynucleotide
cauuauuaugacauaagcuaccugg

SEQ ID NO: 959 - RNA, 25 nt, Artificial Sequence
  synthetic polynucleotide
uucaucuuccaagcaucauuacuaa

SEQ ID NO: 960 - RNA, 25 nt, Artificial Sequence
  synthetic polynucleotide
ucuuccaagcaucauuacuaaccaa

SEQ ID NO: 961 - RNA, 25 nt, Artificial Sequence
  synthetic polynucleotide
cauuacuaaccaagucagacguuaa

SEQ ID NO: 962 - RNA, 25 nt, Artificial Sequence
  synthetic polynucleotide
uaggaaaaggaggaauguuauagau

SEQ ID NO: 963 - RNA, 25 nt, Artificial Sequence
  synthetic polynucleotide
uuguuauuacaaagaggacacuuca

SEQ ID NO: 964 - RNA, 25 nt, Artificial Sequence
  synthetic polynucleotide
ggggaaaaaaguccaggucagcaua

SEQ ID NO: 965 - RNA, 25 nt, Artificial Sequence
  synthetic polynucleotide
aggucagcauaagucauuuugugua

SEQ ID NO: 966 - RNA, 25 nt, Artificial Sequence
  synthetic polynucleotide
uuucuuuccucugagugagaguuau

SEQ ID NO: 967 - RNA, 25 nt, Artificial Sequence
  synthetic polynucleotide
uuuccucugagugagaguuaucuau

SEQ ID NO: 968 - RNA, 25 nt, Artificial Sequence
  synthetic polynucleotide
uaaaaauuaauaggcaaagcaaugg

SEQ ID NO: 969 - RNA, 25 nt, Artificial Sequence
  synthetic polynucleotide
aaaauuaauaggcaaagcaauggaa

SEQ ID NO: 970 - RNA, 25 nt, Artificial Sequence
  synthetic polynucleotide
uuuuuuggaauuuccugaccauuaa

SEQ ID NO: 971 - RNA, 25 nt, Artificial Sequence
  synthetic polynucleotide
auuaaagaauuggauuugcaaguuu

SEQ ID NO: 972 - RNA, 25 nt, Artificial Sequence
  synthetic polynucleotide
uaaacagcccuuguguuggauguaa

SEQ ID NO: 973 - RNA, 25 nt, Artificial Sequence
  synthetic polynucleotide
caaucccagauuugaguguguguug

SEQ ID NO: 974 - RNA, 25 nt, Artificial Sequence
  synthetic polynucleotide
aaucccagauuugaguguguguuga

SEQ ID NO: 975 - RNA, 25 nt, Artificial Sequence
  synthetic polynucleotide
ccagauuugaguguguguugauuau

SEQ ID NO: 976 - RNA, 25 nt, Artificial Sequence
  synthetic polynucleotide
gucuuuccucaugaaugcacugaua

SEQ ID NO: 977 - RNA, 25 nt, Artificial Sequence
  synthetic polynucleotide
uauuuuuguguuaaucagcaguaca

SEQ ID NO: 978 - RNA, 25 nt, Artificial Sequence
  synthetic polynucleotide
acaauuugaucguuggcaugguuaa

SEQ ID NO: 979 - RNA, 25 nt, Artificial Sequence
  synthetic polynucleotide
guuuuuguggugcucuagugguaaa

SEQ ID NO: 980 - RNA, 25 nt, Artificial Sequence
  synthetic polynucleotide
uuuguggugcucuagugguaaauaa

SEQ ID NO: 981 - RNA, 25 nt, Artificial Sequence
  synthetic polynucleotide
uuguggugcucuagugguaaauaaa

SEQ ID NO: 982 - RNA, 25 nt, Artificial Sequence
  synthetic polynucleotide
ucaguaccaucaucgagucuagaaa

SEQ ID NO: 983 - RNA, 25 nt, Artificial Sequence
  synthetic polynucleotide
uucucccuuaaggacagucacuuca

SEQ ID NO: 984 - RNA, 25 nt, Artificial Sequence
  synthetic polynucleotide
cagucacuucagaagucaugcuuua

SEQ ID NO: 985 - RNA, 25 nt, Artificial Sequence
  synthetic polynucleotide
gucacuucagaagucaugcuuuaaa

SEQ ID NO: 986 - RNA, 25 nt, Artificial Sequence
  synthetic polynucleotide
guaauuguuugagauuuaguuucca

SEQ ID NO: 987 - RNA, 25 nt, Artificial Sequence
  synthetic polynucleotide
cgccagggccaaaagaacuggucua

SEQ ID NO: 988 - RNA, 25 nt, Artificial Sequence
  synthetic polynucleotide
ccagacuccucaaacgaguugccaa

SEQ ID NO: 989 - RNA, 13 nt, Artificial Sequence
  synthetic polynucleotide
uauuuauugugua

SEQ ID NO: 990 - RNA, 19 nt, Artificial Sequence
  synthetic polynucleotide
uacacaauaaauaacucac

SEQ ID NO: 991 - RNA, 14 nt, Artificial Sequence
  synthetic polynucleotide
uuauuuauugugua

SEQ ID NO: 992 - RNA, 19 nt, Artificial Sequence
  synthetic polynucleotide
uacacaauaaauaacucac

SEQ ID NO: 993 - RNA, 13 nt, Artificial Sequence
  synthetic polynucleotide
aucaguguuaaaa

SEQ ID NO: 994 - RNA, 19 nt, Artificial Sequence
  synthetic polynucleotide
uuuuaacacugaugaacca

SEQ ID NO: 995 - RNA, 14 nt, Artificial Sequence
  synthetic polynucleotide
caucaguguuaaaa

SEQ ID NO: 996 - RNA, 19 nt, Artificial Sequence
  synthetic polynucleotide
uuuuaacacugaugaacca

SEQ ID NO: 997 - RNA, 13 nt, Artificial Sequence
  synthetic polynucleotide
auggcuuaaggaa

SEQ ID NO: 998 - RNA, 19 nt, Artificial Sequence
  synthetic polynucleotide
uuccuuaagccauccauga

SEQ ID NO: 999 - RNA, 14 nt, Artificial Sequence
  synthetic polynucleotide
gauggcuuaaggaa

SEQ ID NO: 1000 - RNA, 19 nt, Artificial Sequence
  synthetic polynucleotide
uuccuuaagccauccauga

SEQ ID NO: 1001 - RNA, 13 nt, Artificial Sequence
  synthetic polynucleotide
uuguguucuguua

SEQ ID NO: 1002 - RNA, 19 nt, Artificial Sequence
  synthetic polynucleotide
uaacagaacacaaacuucc

SEQ ID NO: 1003 - RNA, 14 nt, Artificial Sequence
  synthetic polynucleotide
uuuguguucuguua

SEQ ID NO: 1004 - RNA, 19 nt, Artificial Sequence
  synthetic polynucleotide
uaacagaacacaaacuucc

SEQ ID NO: 1005 - RNA, 13 nt, Artificial Sequence
  synthetic polynucleotide
aaauacuuugcca

SEQ ID NO: 1006 - RNA, 19 nt, Artificial Sequence
  synthetic polynucleotide
uggcaaaguauuuggucuc

SEQ ID NO: 1007 - RNA, 14 nt, Artificial Sequence
  synthetic polynucleotide
caaauacuuugcca

SEQ ID NO: 1008 - RNA, 19 nt, Artificial Sequence
  synthetic polynucleotide
uggcaaaguauuuggucuc

SEQ ID NO: 1009 - RNA, 13 nt, Artificial Sequence
  synthetic polynucleotide
cuugcacuacaaa

SEQ ID NO: 1010 - RNA, 19 nt, Artificial Sequence
  synthetic polynucleotide
uuuguagugcaagucaaac

SEQ ID NO: 1011 - RNA, 14 nt, Artificial Sequence
  synthetic polynucleotide
acuugcacuacaaa

SEQ ID NO: 1012 - RNA, 19 nt, Artificial Sequence
  synthetic polynucleotide
uuuguagugcaagucaaac

SEQ ID NO: 1013 - RNA, 13 nt, Artificial Sequence
  synthetic polynucleotide
gaauuuauuagua

SEQ ID NO: 1014 - RNA, 19 nt, Artificial Sequence
  synthetic polynucleotide
uacuaauaaauucuuccag

SEQ ID NO: 1015 - RNA, 14 nt, Artificial Sequence
  synthetic polynucleotide
agaauuuauuagua

SEQ ID NO: 1016 - RNA, 19 nt, Artificial Sequence
  synthetic polynucleotide
uacuaauaaauucuuccag

SEQ ID NO: 1017 - RNA, 13 nt, Artificial Sequence
  synthetic polynucleotide
uugcacuacaaaa

SEQ ID NO: 1018 - RNA, 19 nt, Artificial Sequence
  synthetic polynucleotide
uuuuguagugcaagucaaa

SEQ ID NO: 1019 - RNA, 14 nt, Artificial Sequence
  synthetic polynucleotide
cuugcacuacaaaa

SEQ ID NO: 1020 - RNA, 19 nt, Artificial Sequence
  synthetic polynucleotide
uuuuguagugcaagucaaa

SEQ ID NO: 1021 - RNA, 13 nt, Artificial Sequence
  synthetic polynucleotide
auaaaacagguga

SEQ ID NO: 1022 - RNA, 19 nt, Artificial Sequence
  synthetic polynucleotide
ucaccuguuuuauuuucca

SEQ ID NO: 1023 - RNA, 14 nt, Artificial Sequence
  synthetic polynucleotide
aauaaaacagguga

SEQ ID NO: 1024 - RNA, 19 nt, Artificial Sequence
  synthetic polynucleotide
ucaccuguuuuauuuucca

SEQ ID NO: 1025 - RNA, 13 nt, Artificial Sequence
  synthetic polynucleotide
gacaacaacaaca

SEQ ID NO: 1026 - RNA, 19 nt, Artificial Sequence
  synthetic polynucleotide
uguuguuguugucguuguu

SEQ ID NO: 1027 - RNA, 13 nt, Artificial Sequence
  synthetic polynucleotide
augcuuguaacaa

SEQ ID NO: 1028 - RNA, 19 nt, Artificial Sequence
  synthetic polynucleotide
uuguuacaagcaucaucgu

SEQ ID NO: 1029 - RNA, 13 nt, Artificial Sequence
  synthetic polynucleotide
cagaaacucauga

SEQ ID NO: 1030 - RNA, 19 nt, Artificial Sequence
  synthetic polynucleotide
ucaugaguuucuggcaaag

SEQ ID NO: 1031 - RNA, 13 nt, Artificial Sequence
  synthetic polynucleotide
guauugcuaugca

SEQ ID NO: 1032 - RNA, 19 nt, Artificial Sequence
  synthetic polynucleotide
ugcauagcaauacagaaaa

SEQ ID NO: 1033 - RNA, 13 nt, Artificial Sequence
  synthetic polynucleotide
ccagaaacucaua

SEQ ID NO: 1034 - RNA, 19 nt, Artificial Sequence
  synthetic polynucleotide
uaugaguuucuggcaaagu

SEQ ID NO: 1035 - RNA, 13 nt, Artificial Sequence
  synthetic polynucleotide
acucaaacgagca

SEQ ID NO: 1036 - RNA, 19 nt, Artificial Sequence
  synthetic polynucleotide
ugcucguuugaguucaagu

SEQ ID NO: 1037 - RNA, 13 nt, Artificial Sequence
  synthetic polynucleotide
auaugaccgagaa

SEQ ID NO: 1038 - RNA, 19 nt, Artificial Sequence
  synthetic polynucleotide
uucucggucauauaauaac

SEQ ID NO: 1039 - RNA, 13 nt, Artificial Sequence
  synthetic polynucleotide
cgacgacaacgaa

SEQ ID NO: 1040 - RNA, 19 nt, Artificial Sequence
  synthetic polynucleotide
uucguugucgucgucauca

SEQ ID NO: 1041 - RNA, 13 nt, Artificial Sequence
  synthetic polynucleotide
guaaaccagugaa

SEQ ID NO: 1042 - RNA, 19 nt, Artificial Sequence
  synthetic polynucleotide
uucacugguuuacuaaacu

SEQ ID NO: 1043 - RNA, 13 nt, Artificial Sequence
  synthetic polynucleotide
uugucaguuuaga

SEQ ID NO: 1044 - RNA, 19 nt, Artificial Sequence
  synthetic polynucleotide
ucuaaacugacaaagaacc

SEQ ID NO: 1045 - RNA, 13 nt, Artificial Sequence
  synthetic polynucleotide
ucaucaguguuaa

SEQ ID NO: 1046 - RNA, 19 nt, Artificial Sequence
  synthetic polynucleotide
uuaacacugaugaaccaag

SEQ ID NO: 1047 - RNA, 13 nt, Artificial Sequence
  synthetic polynucleotide
aacucaaacgaga

SEQ ID NO: 1048 - RNA, 19 nt, Artificial Sequence
  synthetic polynucleotide
ucucguuugaguucaaguu

SEQ ID NO: 1049 - RNA, 13 nt, Artificial Sequence
  synthetic polynucleotide
cgacaacaacaaa

SEQ ID NO: 1050 - RNA, 19 nt, Artificial Sequence
  synthetic polynucleotide
uuuguuguugucguuguuc

SEQ ID NO: 1051 - RNA, 13 nt, Artificial Sequence
  synthetic polynucleotide
acgacaacgauga

SEQ ID NO: 1052 - RNA, 19 nt, Artificial Sequence
  synthetic polynucleotide
ucaucguugucgucgucau

SEQ ID NO: 1053 - RNA, 13 nt, Artificial Sequence
  synthetic polynucleotide
gcugccuaaggaa

SEQ ID NO: 1054 - RNA, 19 nt, Artificial Sequence
  synthetic polynucleotide
uuccuuaggcagcugauac

SEQ ID NO: 1055 - RNA, 13 nt, Artificial Sequence
  synthetic polynucleotide
auucuacauuuca

SEQ ID NO: 1056 - RNA, 19 nt, Artificial Sequence
  synthetic polynucleotide
ugaaauguagaauaaggcc

SEQ ID NO: 1057 - RNA, 13 nt, Artificial Sequence
  synthetic polynucleotide
guguguugauuaa

SEQ ID NO: 1058 - RNA, 19 nt, Artificial Sequence
  synthetic polynucleotide
uuaaucaacacacacucaa

SEQ ID NO: 1059 - RNA, 20 nt, Artificial Sequence
  synthetic polynucleotide
uaucaaaugugaucuggaug

SEQ ID NO: 1060 - RNA, 10 nt, Artificial Sequence
  synthetic polynucleotide
aaaaaaaaaa

SEQ ID NO: 1061 - RNA, 13 nt, Artificial Sequence
  synthetic polynucleotide
cggugacaaugaa

SEQ ID NO: 1062 - RNA, 19 nt, Artificial Sequence
  synthetic polynucleotide
uucauugucaccgugauuu

SEQ ID NO: 1063 - RNA, 13 nt, Artificial Sequence
  synthetic polynucleotide
uugucucgguaua

SEQ ID NO: 1064 - RNA, 19 nt, Artificial Sequence
  synthetic polynucleotide
uauaccgagacaaagggaa

SEQ ID NO: 1065 - RNA, 13 nt, Artificial Sequence
  synthetic polynucleotide
gaguuguauguaa

SEQ ID NO: 1066 - RNA, 19 nt, Artificial Sequence
  synthetic polynucleotide
uuacauacaacuccacuga

SEQ ID NO: 1067 - RNA, 13 nt, Artificial Sequence
  synthetic polynucleotide
auuuguuagugua

SEQ ID NO: 1068 - RNA, 19 nt, Artificial Sequence
  synthetic polynucleotide
uacacuaacaaauucuucc

SEQ ID NO: 1069 - RNA, 13 nt, Artificial Sequence
  synthetic polynucleotide
gcaagucugagaa

SEQ ID NO: 1070 - RNA, 19 nt, Artificial Sequence
  synthetic polynucleotide
uucucagacuugcucaguu

SEQ ID NO: 1071 - RNA, 13 nt, Artificial Sequence
  synthetic polynucleotide
aaaucacggugaa

SEQ ID NO: 1072 - RNA, 19 nt, Artificial Sequence
  synthetic polynucleotide
uucaccgugauuuucaucc

SEQ ID NO: 1073 - RNA, 13 nt, Artificial Sequence
  synthetic polynucleotide
aaaugcagcuaaa

SEQ ID NO: 1074 - RNA, 19 nt, Artificial Sequence
  synthetic polynucleotide
uuuagcugcauuuacaaga

SEQ ID NO: 1075 - RNA, 13 nt, Artificial Sequence
  synthetic polynucleotide
cuuggaaaauaaa

SEQ ID NO: 1076 - RNA, 19 nt, Artificial Sequence
  synthetic polynucleotide
uuuauuuuccaagggcaau

SEQ ID NO: 1077 - RNA, 13 nt, Artificial Sequence
  synthetic polynucleotide
ccuuugaauaaaa

SEQ ID NO: 1078 - RNA, 19 nt, Artificial Sequence
  synthetic polynucleotide
uuuuauucaaagguacugg

SEQ ID NO: 1079 - RNA, 13 nt, Artificial Sequence
  synthetic polynucleotide
aacacacugcaaa

SEQ ID NO: 1080 - RNA, 19 nt, Artificial Sequence
  synthetic polynucleotide
uuugcaguguguuuucauc

SEQ ID NO: 1081 - RNA, 13 nt, Artificial Sequence
  synthetic polynucleotide
aaaacacacugca

SEQ ID NO: 1082 - RNA, 19 nt, Artificial Sequence
  synthetic polynucleotide
ugcaguguguuuucaucau

SEQ ID NO: 1083 - RNA, 13 nt, Artificial Sequence
  synthetic polynucleotide
gaaggccuguuaa

SEQ ID NO: 1084 - RNA, 19 nt, Artificial Sequence
  synthetic polynucleotide
uuaacaggccuucuggaca

SEQ ID NO: 1085 - RNA, 13 nt, Artificial Sequence
  synthetic polynucleotide
uauugcucugcaa

SEQ ID NO: 1086 - RNA, 19 nt, Artificial Sequence
  synthetic polynucleotide
uugcagagcaauacagagg

SEQ ID NO: 1087 - RNA, 13 nt, Artificial Sequence
  synthetic polynucleotide
gaugaaucugaua

SEQ ID NO: 1088 - RNA, 19 nt, Artificial Sequence
  synthetic polynucleotide
uaucagauucaucagaaug

SEQ ID NO: 1089 - RNA, 14 nt, Artificial Sequence
  synthetic polynucleotide
ugaugaaucugaua

SEQ ID NO: 1090 - RNA, 19 nt, Artificial Sequence
  synthetic polynucleotide
uaucagauucaucagaaug

SEQ ID NO: 1091 - RNA, 13 nt, Artificial Sequence
  synthetic polynucleotide
auuugcuuuugca

SEQ ID NO: 1092 - RNA, 19 nt, Artificial Sequence
  synthetic polynucleotide
ugcaaaagcaaaucacugc

SEQ ID NO: 1093 - RNA, 14 nt, Artificial Sequence
  synthetic polynucleotide
gauuugcuuuugca

SEQ ID NO: 1094 - RNA, 19 nt, Artificial Sequence
  synthetic polynucleotide
ugcaaaagcaaaucacugc

SEQ ID NO: 1095 - RNA, 13 nt, Artificial Sequence
  synthetic polynucleotide
gugauuugcuuua

SEQ ID NO: 1096 - RNA, 19 nt, Artificial Sequence
  synthetic polynucleotide
uaaagcaaaucacugcaau

SEQ ID NO: 1097 - RNA, 14 nt, Artificial Sequence
  synthetic polynucleotide
agugauuugcuuua

SEQ ID NO: 1098 - RNA, 19 nt, Artificial Sequence
  synthetic polynucleotide
uaaagcaaaucacugcaau

SEQ ID NO: 1099 - RNA, 13 nt, Artificial Sequence
  synthetic polynucleotide
aauuucguauuua

SEQ ID NO: 1100 - RNA, 19 nt, Artificial Sequence
  synthetic polynucleotide
uaaauacgaaauuucaggu

SEQ ID NO: 1101 - RNA, 14 nt, Artificial Sequence
  synthetic polynucleotide
aaauuucguauuua

SEQ ID NO: 1102 - RNA, 19 nt, Artificial Sequence
  synthetic polynucleotide
uaaauacgaaauuucaggu

SEQ ID NO: 1103 - RNA, 13 nt, Artificial Sequence
  synthetic polynucleotide
cacagccaugaaa

SEQ ID NO: 1104 - RNA, 19 nt, Artificial Sequence
  synthetic polynucleotide
uuucauggcugugaaauuc

SEQ ID NO: 1105 - RNA, 14 nt, Artificial Sequence
  synthetic polynucleotide
ucacagccaugaaa

SEQ ID NO: 1106 - RNA, 19 nt, Artificial Sequence
  synthetic polynucleotide
uuucauggcugugaaauuc

SEQ ID NO: 1107 - RNA, 13 nt, Artificial Sequence
  synthetic polynucleotide
gauuugcuuuuga

SEQ ID NO: 1108 - RNA, 19 nt, Artificial Sequence
  synthetic polynucleotide
ucaaaagcaaaucacugca

SEQ ID NO: 1109 - RNA, 14 nt, Artificial Sequence
  synthetic polynucleotide
ugauuugcuuuuga

SEQ ID NO: 1110 - RNA, 19 nt, Artificial Sequence
  synthetic polynucleotide
ucaaaagcaaaucacugca

SEQ ID NO: 1111 - RNA, 13 nt, Artificial Sequence
  synthetic polynucleotide
uugcuuuugccua

SEQ ID NO: 1112 - RNA, 19 nt, Artificial Sequence
  synthetic polynucleotide
uaggcaaaagcaaaucacu

SEQ ID NO: 1113 - RNA, 14 nt, Artificial Sequence
  synthetic polynucleotide
uuugcuuuugccua

SEQ ID NO: 1114 - RNA, 19 nt, Artificial Sequence
  synthetic polynucleotide
uaggcaaaagcaaaucacu

SEQ ID NO: 1115 - RNA, 13 nt, Artificial Sequence
  synthetic polynucleotide
uuucucaguuuaa

SEQ ID NO: 1116 - RNA, 19 nt, Artificial Sequence
  synthetic polynucleotide
uuaaacugagaaagaagca

SEQ ID NO: 1117 - RNA, 13 nt, Artificial Sequence
  synthetic polynucleotide
uugcauuuaguca

SEQ ID NO: 1118 - RNA, 19 nt, Artificial Sequence
  synthetic polynucleotide
ugacuaaaugcaaagugag

SEQ ID NO: 1119 - RNA, 13 nt, Artificial Sequence
  synthetic polynucleotide
acuuugcauuuaa

SEQ ID NO: 1120 - RNA, 19 nt, Artificial Sequence
  synthetic polynucleotide
uuaaaugcaaagugagaaa

SEQ ID NO: 1121 - RNA, 13 nt, Artificial Sequence
  synthetic polynucleotide
auuuagucaaaaa

SEQ ID NO: 1122 - RNA, 19 nt, Artificial Sequence
  synthetic polynucleotide
uuuuugacuaaaugcaaag

SEQ ID NO: 1123 - RNA, 13 nt, Artificial Sequence
  synthetic polynucleotide
uucuuucucagua

SEQ ID NO: 1124 - RNA, 19 nt, Artificial Sequence
  synthetic polynucleotide
uacugagaaagaagcauuu

SEQ ID NO: 1125 - RNA, 13 nt, Artificial Sequence
  synthetic polynucleotide
ucuuucucaguua

SEQ ID NO: 1126 - RNA, 19 nt, Artificial Sequence
  synthetic polynucleotide
uaacugagaaagaagcauu

SEQ ID NO: 1127 - RNA, 13 nt, Artificial Sequence
  synthetic polynucleotide
gaaagagaacaua

SEQ ID NO: 1128 - RNA, 19 nt, Artificial Sequence
  synthetic polynucleotide
uauguucucuuucauuuug

SEQ ID NO: 1129 - RNA, 13 nt, Artificial Sequence
  synthetic polynucleotide
cuuugcauuuaga

SEQ ID NO: 1130 - RNA, 19 nt, Artificial Sequence
  synthetic polynucleotide
ucuaaaugcaaagugagaa

SEQ ID NO: 1131 - RNA, 13 nt, Artificial Sequence
  synthetic polynucleotide
uuugcauuuagua

SEQ ID NO: 1132 - RNA, 19 nt, Artificial Sequence
  synthetic polynucleotide
uacuaaaugcaaagugaga

SEQ ID NO: 1133 - RNA, 13 nt, Artificial Sequence
  synthetic polynucleotide
cucacuuugcaua

SEQ ID NO: 1134 - RNA, 19 nt, Artificial Sequence
  synthetic polynucleotide
uaugcaaagugagaaauug

SEQ ID NO: 1135 - RNA, 13 nt, Artificial Sequence
  synthetic polynucleotide
uucucacuuugca

SEQ ID NO: 1136 - RNA, 19 nt, Artificial Sequence
  synthetic polynucleotide
ugcaaagugagaaauugua

SEQ ID NO: 1137 - RNA, 13 nt, Artificial Sequence
  synthetic polynucleotide
cacuccaguugua

SEQ ID NO: 1138 - RNA, 19 nt, Artificial Sequence
  synthetic polynucleotide
uacaacuggagugaaaacu

SEQ ID NO: 1139 - RNA, 13 nt, Artificial Sequence
  synthetic polynucleotide
aaugaaagagaaa

SEQ ID NO: 1140 - RNA, 19 nt, Artificial Sequence
  synthetic polynucleotide
uuucucuuucauuuugcua

SEQ ID NO: 1141 - RNA, 13 nt, Artificial Sequence
  synthetic polynucleotide
ugcagugauuuga

SEQ ID NO: 1142 - RNA, 19 nt, Artificial Sequence
  synthetic polynucleotide
ucaaaucacugcaauucuc

SEQ ID NO: 1143 - RNA, 13 nt, Artificial Sequence
  synthetic polynucleotide
ugaaagagaacaa

SEQ ID NO: 1144 - RNA, 19 nt, Artificial Sequence
  synthetic polynucleotide
uuguucucuuucauuuugc

SEQ ID NO: 1145 - RNA, 13 nt, Artificial Sequence
  synthetic polynucleotide
accugaaauuuca

SEQ ID NO: 1146 - RNA, 19 nt, Artificial Sequence
  synthetic polynucleotide
ugaaauuucagguguuuau

SEQ ID NO: 1147 - RNA, 13 nt, Artificial Sequence
  synthetic polynucleotide
gaauugcagugaa

SEQ ID NO: 1148 - RNA, 19 nt, Artificial Sequence
  synthetic polynucleotide
uucacugcaauucucaugg

SEQ ID NO: 1149 - RNA, 13 nt, Artificial Sequence
  synthetic polynucleotide
ggcugauucugga

SEQ ID NO: 1150 - RNA, 19 nt, Artificial Sequence
  synthetic polynucleotide
uccagaaucagccuguuua

SEQ ID NO: 1151 - RNA, 13 nt, Artificial Sequence
  synthetic polynucleotide
guucguuguuuca

SEQ ID NO: 1152 - RNA, 19 nt, Artificial Sequence
  synthetic polynucleotide
ugaaacaacgaacuaagcu

SEQ ID NO: 1153 - RNA, 13 nt, Artificial Sequence
  synthetic polynucleotide
gaaagaaauagaa

SEQ ID NO: 1154 - RNA, 19 nt, Artificial Sequence
  synthetic polynucleotide
uucuauuucuuucuccaca

SEQ ID NO: 1155 - RNA, 13 nt, Artificial Sequence
  synthetic polynucleotide
guggagaaagaaa

SEQ ID NO: 1156 - RNA, 19 nt, Artificial Sequence
  synthetic polynucleotide
uuucuuucuccacauacau

SEQ ID NO: 1157 - RNA, 13 nt, Artificial Sequence
  synthetic polynucleotide
cugugucacuaua

SEQ ID NO: 1158 - RNA, 19 nt, Artificial Sequence
  synthetic polynucleotide
uauagugacacagacuauu

SEQ ID NO: 1159 - RNA, 13 nt, Artificial Sequence
  synthetic polynucleotide
guuucucaguuca

SEQ ID NO: 1160 - RNA, 19 nt, Artificial Sequence
  synthetic polynucleotide
ugaacugagaaacaagcag

SEQ ID NO: 1161 - RNA, 13 nt, Artificial Sequence
  synthetic polynucleotide
uacaggaacagca

SEQ ID NO: 1162 - RNA, 19 nt, Artificial Sequence
  synthetic polynucleotide
ugcuguuccuguaaguuug

SEQ ID NO: 1163 - RNA, 13 nt, Artificial Sequence
  synthetic polynucleotide
gcaggcaaacuua

SEQ ID NO: 1164 - RNA, 19 nt, Artificial Sequence
  synthetic polynucleotide
uaaguuugccugccucuac

SEQ ID NO: 1165 - RNA, 13 nt, Artificial Sequence
  synthetic polynucleotide
aacuuacaggaaa

SEQ ID NO: 1166 - RNA, 19 nt, Artificial Sequence
  synthetic polynucleotide
uuuccuguaaguuugccug

SEQ ID NO: 1167 - RNA, 13 nt, Artificial Sequence
  synthetic polynucleotide
cacugcauuuuaa

SEQ ID NO: 1168 - RNA, 19 nt, Artificial Sequence
  synthetic polynucleotide
uuaaaaugcaguggccauu

SEQ ID NO: 1169 - RNA, 13 nt, Artificial Sequence
  synthetic polynucleotide
gacaccacuguaa

SEQ ID NO: 1170 - RNA, 19 nt, Artificial Sequence
  synthetic polynucleotide
uuacaguggugucugcaug

SEQ ID NO: 1171 - RNA, 13 nt, Artificial Sequence
  synthetic polynucleotide
agaggcaggcaaa

SEQ ID NO: 1172 - RNA, 19 nt, Artificial Sequence
  synthetic polynucleotide
uuugccugccucuacauac

SEQ ID NO: 1173 - RNA, 13 nt, Artificial Sequence
  synthetic polynucleotide
uagaggcaggcaa

SEQ ID NO: 1174 - RNA, 19 nt, Artificial Sequence
  synthetic polynucleotide
uugccugccucuacauaca

SEQ ID NO: 1175 - RNA, 13 nt, Artificial Sequence
  synthetic polynucleotide
gagaguucaucua

SEQ ID NO: 1176 - RNA, 19 nt, Artificial Sequence
  synthetic polynucleotide
uagaugaacucucuaauuc

SEQ ID NO: 1177 - RNA, 13 nt, Artificial Sequence
  synthetic polynucleotide
ugugaauaaauca

SEQ ID NO: 1178 - RNA, 19 nt, Artificial Sequence
  synthetic polynucleotide
ugauuuauucacaccacaa

SEQ ID NO: 1179 - RNA, 13 nt, Artificial Sequence
  synthetic polynucleotide
gugaauaaaucua

SEQ ID NO: 1180 - RNA, 19 nt, Artificial Sequence
  synthetic polynucleotide
uagauuuauucacaccaca

SEQ ID NO: 1181 - RNA, 13 nt, Artificial Sequence
  synthetic polynucleotide
ugaauaaaucuua

SEQ ID NO: 1182 - RNA, 19 nt, Artificial Sequence
  synthetic polynucleotide
uaagauuuauucacaccac

SEQ ID NO: 1183 - RNA, 25 nt, Artificial Sequence
  synthetic polynucleotide
aaggaaaacucacuaccaugagaaa

SEQ ID NO: 1184 - RNA, 25 nt, Artificial Sequence
  synthetic polynucleotide
aacucacuaccaugagaauugcaga

SEQ ID NO: 1185 - RNA, 25 nt, Artificial Sequence
  synthetic polynucleotide
cucacuaccaugagaauugcaguga

SEQ ID NO: 1186 - RNA, 25 nt, Artificial Sequence
  synthetic polynucleotide
ucacuaccaugagaauugcagugaa

SEQ ID NO: 1187 - RNA, 25 nt, Artificial Sequence
  synthetic polynucleotide
uaccaugagaauugcagugauuuga

SEQ ID NO: 1188 - RNA, 25 nt, Artificial Sequence
  synthetic polynucleotide
accaugagaauugcagugauuugca

SEQ ID NO: 1189 - RNA, 25 nt, Artificial Sequence
  synthetic polynucleotide
caugagaauugcagugauuugcuua

SEQ ID NO: 1190 - RNA, 25 nt, Artificial Sequence
  synthetic polynucleotide
augagaauugcagugauuugcuuua

SEQ ID NO: 1191 - RNA, 25 nt, Artificial Sequence
  synthetic polynucleotide
ugagaauugcagugauuugcuuuua

SEQ ID NO: 1192 - RNA, 25 nt, Artificial Sequence
  synthetic polynucleotide
gagaauugcagugauuugcuuuuga

SEQ ID NO: 1193 - RNA, 25 nt, Artificial Sequence
  synthetic polynucleotide
agaauugcagugauuugcuuuugca

SEQ ID NO: 1194 - RNA, 25 nt, Artificial Sequence
  synthetic polynucleotide
gaauugcagugauuugcuuuugcca

SEQ ID NO: 1195 - RNA, 25 nt, Artificial Sequence
  synthetic polynucleotide
aauugcagugauuugcuuuugccua

SEQ ID NO: 1196 - RNA, 25 nt, Artificial Sequence
  synthetic polynucleotide
ugcagugauuugcuuuugccuccua

SEQ ID NO: 1197 - RNA, 25 nt, Artificial Sequence
  synthetic polynucleotide
gcagugauuugcuuuugccuccuaa

SEQ ID NO: 1198 - RNA, 25 nt, Artificial Sequence
  synthetic polynucleotide
cagugauuugcuuuugccuccuaga

SEQ ID NO: 1199 - RNA, 25 nt, Artificial Sequence
  synthetic polynucleotide
gcaucaccugugccauaccaguuaa

SEQ ID NO: 1200 - RNA, 25 nt, Artificial Sequence
  synthetic polynucleotide
aucaccugugccauaccaguuaaaa

SEQ ID NO: 1201 - RNA, 25 nt, Artificial Sequence
  synthetic polynucleotide
ccugugccauaccaguuaaacagga

SEQ ID NO: 1202 - RNA, 25 nt, Artificial Sequence
  synthetic polynucleotide
gugccauaccaguuaaacaggcuga

SEQ ID NO: 1203 - RNA, 25 nt, Artificial Sequence
  synthetic polynucleotide
ugccauaccaguuaaacaggcugaa

SEQ ID NO: 1204 - RNA, 25 nt, Artificial Sequence
  synthetic polynucleotide
auaccaguuaaacaggcugauucua

SEQ ID NO: 1205 - RNA, 25 nt, Artificial Sequence
  synthetic polynucleotide
uaccaguuaaacaggcugauucuga

SEQ ID NO: 1206 - RNA, 25 nt, Artificial Sequence
  synthetic polynucleotide
accaguuaaacaggcugauucugga

SEQ ID NO: 1207 - RNA, 25 nt, Artificial Sequence
  synthetic polynucleotide
aguuaaacaggcugauucuggaaga

SEQ ID NO: 1208 - RNA, 25 nt, Artificial Sequence
  synthetic polynucleotide
guuaaacaggcugauucuggaagua

SEQ ID NO: 1209 - RNA, 25 nt, Artificial Sequence
  synthetic polynucleotide
uuaaacaggcugauucuggaaguua

SEQ ID NO: 1210 - RNA, 25 nt, Artificial Sequence
  synthetic polynucleotide
uaaacaggcugauucuggaaguuca

SEQ ID NO: 1211 - RNA, 25 nt, Artificial Sequence
  synthetic polynucleotide
ggcugauucuggaaguucugaggaa

SEQ ID NO: 1212 - RNA, 25 nt, Artificial Sequence
  synthetic polynucleotide
cugauucuggaaguucugaggaaaa

SEQ ID NO: 1213 - RNA, 25 nt, Artificial Sequence
  synthetic polynucleotide
gauucuggaaguucugaggaaaaga

SEQ ID NO: 1214 - RNA, 25 nt, Artificial Sequence
  synthetic polynucleotide
auucuggaaguucugaggaaaagca

SEQ ID NO: 1215 - RNA, 25 nt, Artificial Sequence
  synthetic polynucleotide
uucuggaaguucugaggaaaagcaa

SEQ ID NO: 1216 - RNA, 25 nt, Artificial Sequence
  synthetic polynucleotide
ccccacagacccuuccaaguaagua

SEQ ID NO: 1217 - RNA, 25 nt, Artificial Sequence
  synthetic polynucleotide
ccacagacccuuccaaguaagucca

SEQ ID NO: 1218 - RNA, 25 nt, Artificial Sequence
  synthetic polynucleotide
acagacccuuccaaguaaguccaaa

SEQ ID NO: 1219 - RNA, 25 nt, Artificial Sequence
  synthetic polynucleotide
cagacccuuccaaguaaguccaaca

SEQ ID NO: 1220 - RNA, 25 nt, Artificial Sequence
  synthetic polynucleotide
gacccuuccaaguaaguccaacgaa

SEQ ID NO: 1221 - RNA, 25 nt, Artificial Sequence
  synthetic polynucleotide
ccuuccaaguaaguccaacgaaaga

SEQ ID NO: 1222 - RNA, 25 nt, Artificial Sequence
  synthetic polynucleotide
cuuccaaguaaguccaacgaaagca

SEQ ID NO: 1223 - RNA, 25 nt, Artificial Sequence
  synthetic polynucleotide
uccaaguaaguccaacgaaagccaa

SEQ ID NO: 1224 - RNA, 25 nt, Artificial Sequence
  synthetic polynucleotide
caaguaaguccaacgaaagccauga

SEQ ID NO: 1225 - RNA, 25 nt, Artificial Sequence
  synthetic polynucleotide
aaguccaacgaaagccaugaccaca

SEQ ID NO: 1226 - RNA, 25 nt, Artificial Sequence
  synthetic polynucleotide
ccaacgaaagccaugaccacaugga

SEQ ID NO: 1227 - RNA, 25 nt, Artificial Sequence
  synthetic polynucleotide
caacgaaagccaugaccacauggaa

SEQ ID NO: 1228 - RNA, 25 nt, Artificial Sequence
  synthetic polynucleotide
cgaaagccaugaccacauggaugaa

SEQ ID NO: 1229 - RNA, 25 nt, Artificial Sequence
  synthetic polynucleotide
ccaugaccacauggaugauauggaa

SEQ ID NO: 1230 - RNA, 25 nt, Artificial Sequence
  synthetic polynucleotide
accacauggaugauauggaugauga

SEQ ID NO: 1231 - RNA, 25 nt, Artificial Sequence
  synthetic polynucleotide
ggaugaugaagaugaugaugaccaa

SEQ ID NO: 1232 - RNA, 25 nt, Artificial Sequence
  synthetic polynucleotide
gaugaugaagaugaugaugaccaua

SEQ ID NO: 1233 - RNA, 25 nt, Artificial Sequence
  synthetic polynucleotide
ugaugaagaugaugaugaccaugua

SEQ ID NO: 1234 - RNA, 25 nt, Artificial Sequence
  synthetic polynucleotide
augaagaugaugaugaccaugugga

SEQ ID NO: 1235 - RNA, 25 nt, Artificial Sequence
  synthetic polynucleotide
ugaagaugaugaugaccauguggaa

SEQ ID NO: 1236 - RNA, 25 nt, Artificial Sequence
  synthetic polynucleotide
gacuccauugacucgaacgacucua

SEQ ID NO: 1237 - RNA, 25 nt, Artificial Sequence
  synthetic polynucleotide
acuccauugacucgaacgacucuga

SEQ ID NO: 1238 - RNA, 25 nt, Artificial Sequence
  synthetic polynucleotide
cuccauugacucgaacgacucugaa

SEQ ID NO: 1239 - RNA, 25 nt, Artificial Sequence
  synthetic polynucleotide
cauugacucgaacgacucugaugaa

SEQ ID NO: 1240 - RNA, 25 nt, Artificial Sequence
  synthetic polynucleotide
acucgaacgacucugaugauguaga

SEQ ID NO: 1241 - RNA, 25 nt, Artificial Sequence
  synthetic polynucleotide
cucgaacgacucugaugauguagaa

SEQ ID NO: 1242 - RNA, 25 nt, Artificial Sequence
  synthetic polynucleotide
ucgaacgacucugaugauguagaua

SEQ ID NO: 1243 - RNA, 25 nt, Artificial Sequence
  synthetic polynucleotide
cgaacgacucugaugauguagauga

SEQ ID NO: 1244 - RNA, 25 nt, Artificial Sequence
  synthetic polynucleotide
aacgacucugaugauguagaugaca

SEQ ID NO: 1245 - RNA, 25 nt, Artificial Sequence
  synthetic polynucleotide
acucugaugauguagaugacacuga

SEQ ID NO: 1246 - RNA, 25 nt, Artificial Sequence
  synthetic polynucleotide
cucugaugauguagaugacacugaa

SEQ ID NO: 1247 - RNA, 25 nt, Artificial Sequence
  synthetic polynucleotide
ucugaugauguagaugacacugaua

SEQ ID NO: 1248 - RNA, 25 nt, Artificial Sequence
  synthetic polynucleotide
cugaugauguagaugacacugauga

SEQ ID NO: 1249 - RNA, 25 nt, Artificial Sequence
  synthetic polynucleotide
ugaugauguagaugacacugaugaa

SEQ ID NO: 1250 - RNA, 25 nt, Artificial Sequence
  synthetic polynucleotide
uagaugacacugaugauucucacca

SEQ ID NO: 1251 - RNA, 25 nt, Artificial Sequence
  synthetic polynucleotide
agaugacacugaugauucucaccaa

SEQ ID NO: 1252 - RNA, 25 nt, Artificial Sequence
  synthetic polynucleotide
acugaugauucucaccagucugaua

SEQ ID NO: 1253 - RNA, 25 nt, Artificial Sequence
  synthetic polynucleotide
cugaugauucucaccagucugauga

SEQ ID NO: 1254 - RNA, 25 nt, Artificial Sequence
  synthetic polynucleotide
ugaugauucucaccagucugaugaa

SEQ ID NO: 1255 - RNA, 25 nt, Artificial Sequence
  synthetic polynucleotide
gaugauucucaccagucugaugaga

SEQ ID NO: 1256 - RNA, 25 nt, Artificial Sequence
  synthetic polynucleotide
auucucaccagucugaugagucuca

SEQ ID NO: 1257 - RNA, 25 nt, Artificial Sequence
  synthetic polynucleotide
cucaccagucugaugagucucacca

SEQ ID NO: 1258 - RNA, 25 nt, Artificial Sequence
  synthetic polynucleotide
ucaccagucugaugagucucaccaa

SEQ ID NO: 1259 - RNA, 25 nt, Artificial Sequence
  synthetic polynucleotide
ccagucugaugagucucaccauuca

SEQ ID NO: 1260 - RNA, 25 nt, Artificial Sequence
  synthetic polynucleotide
cagucugaugagucucaccauucua

SEQ ID NO: 1261 - RNA, 25 nt, Artificial Sequence
  synthetic polynucleotide
agucugaugagucucaccauucuga

SEQ ID NO: 1262 - RNA, 25 nt, Artificial Sequence
  synthetic polynucleotide
gucugaugagucucaccauucugaa

SEQ ID NO: 1263 - RNA, 25 nt, Artificial Sequence
  synthetic polynucleotide
ucugaugagucucaccauucugaua

SEQ ID NO: 1264 - RNA, 25 nt, Artificial Sequence
  synthetic polynucleotide
cugaugagucucaccauucugauga

SEQ ID NO: 1265 - RNA, 25 nt, Artificial Sequence
  synthetic polynucleotide
ugaugagucucaccauucugaugaa

SEQ ID NO: 1266 - RNA, 25 nt, Artificial Sequence
  synthetic polynucleotide
gaugagucucaccauucugaugaaa

SEQ ID NO: 1267 - RNA, 25 nt, Artificial Sequence
  synthetic polynucleotide
gagucucaccauucugaugaaucua

SEQ ID NO: 1268 - RNA, 25 nt, Artificial Sequence
  synthetic polynucleotide
gucucaccauucugaugaaucugaa

SEQ ID NO: 1269 - RNA, 25 nt, Artificial Sequence
  synthetic polynucleotide
ucucaccauucugaugaaucugaua

SEQ ID NO: 1270 - RNA, 25 nt, Artificial Sequence
  synthetic polynucleotide
cucaccauucugaugaaucugauga

SEQ ID NO: 1271 - RNA, 25 nt, Artificial Sequence
  synthetic polynucleotide
ucaccauucugaugaaucugaugaa

SEQ ID NO: 1272 - RNA, 25 nt, Artificial Sequence
  synthetic polynucleotide
caccauucugaugaaucugaugaaa

SEQ ID NO: 1273 - RNA, 25 nt, Artificial Sequence
  synthetic polynucleotide
ccauucugaugaaucugaugaacua

SEQ ID NO: 1274 - RNA, 25 nt, Artificial Sequence
  synthetic polynucleotide
ucugaugaaucugaugaacugguca

SEQ ID NO: 1275 - RNA, 25 nt, Artificial Sequence
  synthetic polynucleotide
ugaaucugaugaacuggucacugaa

SEQ ID NO: 1276 - RNA, 25 nt, Artificial Sequence
  synthetic polynucleotide
ccagcaaccgaaguuuucacuccaa

SEQ ID NO: 1277 - RNA, 25 nt, Artificial Sequence
  synthetic polynucleotide
caaccgaaguuuucacuccaguuga

SEQ ID NO: 1278 - RNA, 25 nt, Artificial Sequence
  synthetic polynucleotide
aaccgaaguuuucacuccaguugua

SEQ ID NO: 1279 - RNA, 25 nt, Artificial Sequence
  synthetic polynucleotide
caguuguccccacaguagacacaua

SEQ ID NO: 1280 - RNA, 25 nt, Artificial Sequence
  synthetic polynucleotide
aguuguccccacaguagacacauaa

SEQ ID NO: 1281 - RNA, 25 nt, Artificial Sequence
  synthetic polynucleotide
guuguccccacaguagacacauaua

SEQ ID NO: 1282 - RNA, 25 nt, Artificial Sequence
  synthetic polynucleotide
agacacauaugauggccgaggugaa

SEQ ID NO: 1283 - RNA, 25 nt, Artificial Sequence
  synthetic polynucleotide
gacacauaugauggccgaggugaua

SEQ ID NO: 1284 - RNA, 25 nt, Artificial Sequence
  synthetic polynucleotide
gauggccgaggugauagugugguua

SEQ ID NO: 1285 - RNA, 25 nt, Artificial Sequence
  synthetic polynucleotide
ggccgaggugauagugugguuuaua

SEQ ID NO: 1286 - RNA, 25 nt, Artificial Sequence
  synthetic polynucleotide
gccgaggugauagugugguuuauga

SEQ ID NO: 1287 - RNA, 25 nt, Artificial Sequence
  synthetic polynucleotide
ccgaggugauagugugguuuaugga

SEQ ID NO: 1288 - RNA, 25 nt, Artificial Sequence
  synthetic polynucleotide
cgaggugauagugugguuuauggaa

SEQ ID NO: 1289 - RNA, 25 nt, Artificial Sequence
  synthetic polynucleotide
aggugauagugugguuuauggacua

SEQ ID NO: 1290 - RNA, 25 nt, Artificial Sequence
  synthetic polynucleotide
gugauagugugguuuauggacugaa

SEQ ID NO: 1291 - RNA, 25 nt, Artificial Sequence
  synthetic polynucleotide
ugauagugugguuuauggacugaga

SEQ ID NO: 1292 - RNA, 25 nt, Artificial Sequence
  synthetic polynucleotide
gauagugugguuuauggacugagga

SEQ ID NO: 1293 - RNA, 25 nt, Artificial Sequence
  synthetic polynucleotide
auagugugguuuauggacugaggua

SEQ ID NO: 1294 - RNA, 25 nt, Artificial Sequence
  synthetic polynucleotide
ugugguuuauggacugaggucaaaa

SEQ ID NO: 1295 - RNA, 25 nt, Artificial Sequence
  synthetic polynucleotide
ugguuuauggacugaggucaaaaua

SEQ ID NO: 1296 - RNA, 25 nt, Artificial Sequence
  synthetic polynucleotide
gguuuauggacugaggucaaaauca

SEQ ID NO: 1297 - RNA, 25 nt, Artificial Sequence
  synthetic polynucleotide
guuuauggacugaggucaaaaucua

SEQ ID NO: 1298 - RNA, 25 nt, Artificial Sequence
  synthetic polynucleotide
uuauggacugaggucaaaaucuaaa

SEQ ID NO: 1299 - RNA, 25 nt, Artificial Sequence
  synthetic polynucleotide
uauggacugaggucaaaaucuaaga

SEQ ID NO: 1300 - RNA, 25 nt, Artificial Sequence
  synthetic polynucleotide
auggacugaggucaaaaucuaagaa

SEQ ID NO: 1301 - RNA, 25 nt, Artificial Sequence
  synthetic polynucleotide
uggacugaggucaaaaucuaagaaa

SEQ ID NO: 1302 - RNA, 25 nt, Artificial Sequence
  synthetic polynucleotide
ggacugaggucaaaaucuaagaaga

SEQ ID NO: 1303 - RNA, 25 nt, Artificial Sequence
  synthetic polynucleotide
gacugaggucaaaaucuaagaagua

SEQ ID NO: 1304 - RNA, 25 nt, Artificial Sequence
  synthetic polynucleotide
ugaggucaaaaucuaagaaguuuca

SEQ ID NO: 1305 - RNA, 25 nt, Artificial Sequence
  synthetic polynucleotide
gaggucaaaaucuaagaaguuucga

SEQ ID NO: 1306 - RNA, 25 nt, Artificial Sequence
  synthetic polynucleotide
aggucaaaaucuaagaaguuucgca

SEQ ID NO: 1307 - RNA, 25 nt, Artificial Sequence
  synthetic polynucleotide
ggucaaaaucuaagaaguuucgcaa

SEQ ID NO: 1308 - RNA, 25 nt, Artificial Sequence
  synthetic polynucleotide
aaaaucuaagaaguuucgcagacca

SEQ ID NO: 1309 - RNA, 25 nt, Artificial Sequence
  synthetic polynucleotide
aaaucuaagaaguuucgcagaccua

SEQ ID NO: 1310 - RNA, 25 nt, Artificial Sequence
  synthetic polynucleotide
aaucuaagaaguuucgcagaccuga

SEQ ID NO: 1311 - RNA, 25 nt, Artificial Sequence
  synthetic polynucleotide
acgaggacaucaccucacacaugga

SEQ ID NO: 1312 - RNA, 25 nt, Artificial Sequence
  synthetic polynucleotide
cgaggacaucaccucacacauggaa

SEQ ID NO: 1313 - RNA, 25 nt, Artificial Sequence
  synthetic polynucleotide
aggacaucaccucacacauggaaaa

SEQ ID NO: 1314 - RNA, 25 nt, Artificial Sequence
  synthetic polynucleotide
ccucacacauggaaagcgaggagua

SEQ ID NO: 1315 - RNA, 25 nt, Artificial Sequence
  synthetic polynucleotide
cacauggaaagcgaggaguugaaua

SEQ ID NO: 1316 - RNA, 25 nt, Artificial Sequence
  synthetic polynucleotide
acauggaaagcgaggaguugaauga

SEQ ID NO: 1317 - RNA, 25 nt, Artificial Sequence
  synthetic polynucleotide
cauggaaagcgaggaguugaaugga

SEQ ID NO: 1318 - RNA, 25 nt, Artificial Sequence
  synthetic polynucleotide
gaguugaauggugcauacaaggcca

SEQ ID NO: 1319 - RNA, 25 nt, Artificial Sequence
  synthetic polynucleotide
gccgugggaaggacaguuaugaaaa

SEQ ID NO: 1320 - RNA, 25 nt, Artificial Sequence
  synthetic polynucleotide
ccgugggaaggacaguuaugaaaca

SEQ ID NO: 1321 - RNA, 25 nt, Artificial Sequence
  synthetic polynucleotide
gugggaaggacaguuaugaaacgaa

SEQ ID NO: 1322 - RNA, 25 nt, Artificial Sequence
  synthetic polynucleotide
gggaaggacaguuaugaaacgagua

SEQ ID NO: 1323 - RNA, 25 nt, Artificial Sequence
  synthetic polynucleotide
gaaggacaguuaugaaacgagucaa

SEQ ID NO: 1324 - RNA, 25 nt, Artificial Sequence
  synthetic polynucleotide
aggacaguuaugaaacgagucagca

SEQ ID NO: 1325 - RNA, 25 nt, Artificial Sequence
  synthetic polynucleotide
ggacaguuaugaaacgagucagcua

SEQ ID NO: 1326 - RNA, 25 nt, Artificial Sequence
  synthetic polynucleotide
acaguuaugaaacgagucagcugga

SEQ ID NO: 1327 - RNA, 25 nt, Artificial Sequence
  synthetic polynucleotide
caguuaugaaacgagucagcuggaa

SEQ ID NO: 1328 - RNA, 25 nt, Artificial Sequence
  synthetic polynucleotide
ccacaagcaguccagauuauauaaa

SEQ ID NO: 1329 - RNA, 25 nt, Artificial Sequence
  synthetic polynucleotide
aagcaguccagauuauauaagcgga

SEQ ID NO: 1330 - RNA, 25 nt, Artificial Sequence
  synthetic polynucleotide
aguccagauuauauaagcggaaaga

SEQ ID NO: 1331 - RNA, 25 nt, Artificial Sequence
  synthetic polynucleotide
guccagauuauauaagcggaaagca

SEQ ID NO: 1332 - RNA, 25 nt, Artificial Sequence
  synthetic polynucleotide
agauuauauaagcggaaagccaaua

SEQ ID NO: 1333 - RNA, 25 nt, Artificial Sequence
  synthetic polynucleotide
gauuauauaagcggaaagccaauga

SEQ ID NO: 1334 - RNA, 25 nt, Artificial Sequence
  synthetic polynucleotide
auuauauaagcggaaagccaaugaa

SEQ ID NO: 1335 - RNA, 25 nt, Artificial Sequence
  synthetic polynucleotide
uuauauaagcggaaagccaaugaua

SEQ ID NO: 1336 - RNA, 25 nt, Artificial Sequence
  synthetic polynucleotide
uauaagcggaaagccaaugaugaga

SEQ ID NO: 1337 - RNA, 25 nt, Artificial Sequence
  synthetic polynucleotide
auaagcggaaagccaaugaugagaa

SEQ ID NO: 1338 - RNA, 25 nt, Artificial Sequence
  synthetic polynucleotide
uaagcggaaagccaaugaugagaga

SEQ ID NO: 1339 - RNA, 25 nt, Artificial Sequence
  synthetic polynucleotide
gcggaaagccaaugaugagagcaaa

SEQ ID NO: 1340 - RNA, 25 nt, Artificial Sequence
  synthetic polynucleotide
cggaaagccaaugaugagagcaaua

SEQ ID NO: 1341 - RNA, 25 nt, Artificial Sequence
  synthetic polynucleotide
ggaaagccaaugaugagagcaauga

SEQ ID NO: 1342 - RNA, 25 nt, Artificial Sequence
  synthetic polynucleotide
gaaagccaaugaugagagcaaugaa

SEQ ID NO: 1343 - RNA, 25 nt, Artificial Sequence
  synthetic polynucleotide
aagccaaugaugagagcaaugagca

SEQ ID NO: 1344 - RNA, 25 nt, Artificial Sequence
  synthetic polynucleotide
ccaaugaugagagcaaugagcauua

SEQ ID NO: 1345 - RNA, 25 nt, Artificial Sequence
  synthetic polynucleotide
caaugaugagagcaaugagcauuca

SEQ ID NO: 1346 - RNA, 25 nt, Artificial Sequence
  synthetic polynucleotide
augaugagagcaaugagcauuccga

SEQ ID NO: 1347 - RNA, 25 nt, Artificial Sequence
  synthetic polynucleotide
gaugagagcaaugagcauuccgaua

SEQ ID NO: 1348 - RNA, 25 nt, Artificial Sequence
  synthetic polynucleotide
ugagagcaaugagcauuccgaugua

SEQ ID NO: 1349 - RNA, 25 nt, Artificial Sequence
  synthetic polynucleotide
gcaaugagcauuccgaugugauuga

SEQ ID NO: 1350 - RNA, 25 nt, Artificial Sequence
  synthetic polynucleotide
augagcauuccgaugugauugauaa

SEQ ID NO: 1351 - RNA, 25 nt, Artificial Sequence
  synthetic polynucleotide
ugagcauuccgaugugauugauaga

SEQ ID NO: 1352 - RNA, 25 nt, Artificial Sequence
  synthetic polynucleotide
gagcauuccgaugugauugauagua

SEQ ID NO: 1353 - RNA, 25 nt, Artificial Sequence
  synthetic polynucleotide
gcauuccgaugugauugauagucaa

SEQ ID NO: 1354 - RNA, 25 nt, Artificial Sequence
  synthetic polynucleotide
auuccgaugugauugauagucagga

SEQ ID NO: 1355 - RNA, 25 nt, Artificial Sequence
  synthetic polynucleotide
uccgaugugauugauagucaggaaa

SEQ ID NO: 1356 - RNA, 25 nt, Artificial Sequence
  synthetic polynucleotide
ugugauugauagucaggaacuuuca

SEQ ID NO: 1357 - RNA, 25 nt, Artificial Sequence
  synthetic polynucleotide
gugauugauagucaggaacuuucca

SEQ ID NO: 1358 - RNA, 25 nt, Artificial Sequence
  synthetic polynucleotide
gauugauagucaggaacuuuccaaa

SEQ ID NO: 1359 - RNA, 25 nt, Artificial Sequence
  synthetic polynucleotide
ugauagucaggaacuuuccaaaguc

SEQ ID NO: 1360 - RNA, 25 nt, Artificial Sequence
  synthetic polynucleotide
gauagucaggaacuuuccaaaguca

SEQ ID NO: 1361 - RNA, 25 nt, Artificial Sequence
  synthetic polynucleotide
auagucaggaacuuuccaaagucaa

SEQ ID NO: 1362 - RNA, 25 nt, Artificial Sequence
  synthetic polynucleotide
agucaggaacuuuccaaagucagca

SEQ ID NO: 1363 - RNA, 25 nt, Artificial Sequence
  synthetic polynucleotide
gucaggaacuuuccaaagucagcca

SEQ ID NO: 1364 - RNA, 25 nt, Artificial Sequence
  synthetic polynucleotide
aacuuuccaaagucagccgugaaua

SEQ ID NO: 1365 - RNA, 25 nt, Artificial Sequence
  synthetic polynucleotide
cuuuccaaagucagccgugaauuca

SEQ ID NO: 1366 - RNA, 25 nt, Artificial Sequence
  synthetic polynucleotide
uuuccaaagucagccgugaauucca

SEQ ID NO: 1367 - RNA, 25 nt, Artificial Sequence
  synthetic polynucleotide
ucagccgugaauuccacagccauga

SEQ ID NO: 1368 - RNA, 25 nt, Artificial Sequence
  synthetic polynucleotide
cagccgugaauuccacagccaugaa

SEQ ID NO: 1369 - RNA, 25 nt, Artificial Sequence
  synthetic polynucleotide
agccgugaauuccacagccaugaaa

SEQ ID NO: 1370 - RNA, 25 nt, Artificial Sequence
  synthetic polynucleotide
gaauuccacagccaugaauuucaca

SEQ ID NO: 1371 - RNA, 25 nt, Artificial Sequence
  synthetic polynucleotide
aauuccacagccaugaauuucacaa

SEQ ID NO: 1372 - RNA, 25 nt, Artificial Sequence
  synthetic polynucleotide
auuccacagccaugaauuucacaga

SEQ ID NO: 1373 - RNA, 25 nt, Artificial Sequence
  synthetic polynucleotide
uuccacagccaugaauuucacagca

SEQ ID NO: 1374 - RNA, 25 nt, Artificial Sequence
  synthetic polynucleotide
uccacagccaugaauuucacagcca

SEQ ID NO: 1375 - RNA, 25 nt, Artificial Sequence
  synthetic polynucleotide
acagccaugaauuucacagccauga

SEQ ID NO: 1376 - RNA, 25 nt, Artificial Sequence
  synthetic polynucleotide
agccaugaauuucacagccaugaaa

SEQ ID NO: 1377 - RNA, 25 nt, Artificial Sequence
  synthetic polynucleotide
gccaugaauuucacagccaugaaga

SEQ ID NO: 1378 - RNA, 25 nt, Artificial Sequence
  synthetic polynucleotide
ccaugaauuucacagccaugaagaa

SEQ ID NO: 1379 - RNA, 25 nt, Artificial Sequence
  synthetic polynucleotide
augaauuucacagccaugaagauaa

SEQ ID NO: 1380 - RNA, 25 nt, Artificial Sequence
  synthetic polynucleotide
ugaauuucacagccaugaagauaua

SEQ ID NO: 1381 - RNA, 25 nt, Artificial Sequence
  synthetic polynucleotide
gaauuucacagccaugaagauauga

SEQ ID NO: 1382 - RNA, 25 nt, Artificial Sequence
  synthetic polynucleotide
aauuucacagccaugaagauaugca

SEQ ID NO: 1383 - RNA, 25 nt, Artificial Sequence
  synthetic polynucleotide
auuucacagccaugaagauaugcua

SEQ ID NO: 1384 - RNA, 25 nt, Artificial Sequence
  synthetic polynucleotide
uuucacagccaugaagauaugcuga

SEQ ID NO: 1385 - RNA, 25 nt, Artificial Sequence
  synthetic polynucleotide
cacagccaugaagauaugcugguua

SEQ ID NO: 1386 - RNA, 25 nt, Artificial Sequence
  synthetic polynucleotide
ugguuguagaccccaaaaguaagga

SEQ ID NO: 1387 - RNA, 25 nt, Artificial Sequence
  synthetic polynucleotide
gguuguagaccccaaaaguaaggaa

SEQ ID NO: 1388 - RNA, 25 nt, Artificial Sequence
  synthetic polynucleotide
guuguagaccccaaaaguaaggaaa

SEQ ID NO: 1389 - RNA, 25 nt, Artificial Sequence
  synthetic polynucleotide
uuguagaccccaaaaguaaggaaga

SEQ ID NO: 1390 - RNA, 25 nt, Artificial Sequence
  synthetic polynucleotide
uguagaccccaaaaguaaggaagaa

SEQ ID NO: 1391 - RNA, 25 nt, Artificial Sequence
  synthetic polynucleotide
guagaccccaaaaguaaggaagaaa

SEQ ID NO: 1392 - RNA, 25 nt, Artificial Sequence
  synthetic polynucleotide
uagaccccaaaaguaaggaagaaga

SEQ ID NO: 1393 - RNA, 25 nt, Artificial Sequence
  synthetic polynucleotide
agaccccaaaaguaaggaagaagaa

SEQ ID NO: 1394 - RNA, 25 nt, Artificial Sequence
  synthetic polynucleotide
ccaaaaguaaggaagaagauaaaca

SEQ ID NO: 1395 - RNA, 25 nt, Artificial Sequence
  synthetic polynucleotide
caaaaguaaggaagaagauaaacaa

SEQ ID NO: 1396 - RNA, 25 nt, Artificial Sequence
  synthetic polynucleotide
aaaaguaaggaagaagauaaacaca

SEQ ID NO: 1397 - RNA, 25 nt, Artificial Sequence
  synthetic polynucleotide
aaaguaaggaagaagauaaacacca

SEQ ID NO: 1398 - RNA, 25 nt, Artificial Sequence
  synthetic polynucleotide
aaguaaggaagaagauaaacaccua

SEQ ID NO: 1399 - RNA, 25 nt, Artificial Sequence
  synthetic polynucleotide
guaaggaagaagauaaacaccugaa

SEQ ID NO: 1400 - RNA, 25 nt, Artificial Sequence
  synthetic polynucleotide
uaaggaagaagauaaacaccugaaa

SEQ ID NO: 1401 - RNA, 25 nt, Artificial Sequence
  synthetic polynucleotide
aagaagauaaacaccugaaauuuca

SEQ ID NO: 1402 - RNA, 25 nt, Artificial Sequence
  synthetic polynucleotide
agaagauaaacaccugaaauuucga

SEQ ID NO: 1403 - RNA, 25 nt, Artificial Sequence
  synthetic polynucleotide
gaagauaaacaccugaaauuucgua

SEQ ID NO: 1404 - RNA, 25 nt, Artificial Sequence
  synthetic polynucleotide
aagauaaacaccugaaauuucguaa

SEQ ID NO: 1405 - RNA, 25 nt, Artificial Sequence
  synthetic polynucleotide
auaaacaccugaaauuucguauuua

SEQ ID NO: 1406 - RNA, 25 nt, Artificial Sequence
  synthetic polynucleotide
aaacaccugaaauuucguauuucua

SEQ ID NO: 1407 - RNA, 25 nt, Artificial Sequence
  synthetic polynucleotide
aaauuucguauuucucaugaauuaa

SEQ ID NO: 1408 - RNA, 25 nt, Artificial Sequence
  synthetic polynucleotide
cguauuucucaugaauuagauagua

SEQ ID NO: 1409 - RNA, 25 nt, Artificial Sequence
  synthetic polynucleotide
guauuucucaugaauuagauaguga

SEQ ID NO: 1410 - RNA, 25 nt, Artificial Sequence
  synthetic polynucleotide
uauuucucaugaauuagauagugca

SEQ ID NO: 1411 - RNA, 25 nt, Artificial Sequence
  synthetic polynucleotide
ucucaugaauuagauagugcaucua

SEQ ID NO: 1412 - RNA, 25 nt, Artificial Sequence
  synthetic polynucleotide
cucaugaauuagauagugcaucuua

SEQ ID NO: 1413 - RNA, 25 nt, Artificial Sequence
  synthetic polynucleotide
ucaugaauuagauagugcaucuuca

SEQ ID NO: 1414 - RNA, 25 nt, Artificial Sequence
  synthetic polynucleotide
caugaauuagauagugcaucuucua

SEQ ID NO: 1415 - RNA, 25 nt, Artificial Sequence
  synthetic polynucleotide
augaauuagauagugcaucuucuga

SEQ ID NO: 1416 - RNA, 25 nt, Artificial Sequence
  synthetic polynucleotide
ugaauuagauagugcaucuucugaa

SEQ ID NO: 1417 - RNA, 25 nt, Artificial Sequence
  synthetic polynucleotide
gaauuagauagugcaucuucugaga

SEQ ID NO: 1418 - RNA, 25 nt, Artificial Sequence
  synthetic polynucleotide
aauuagauagugcaucuucugagga

SEQ ID NO: 1419 - RNA, 25 nt, Artificial Sequence
  synthetic polynucleotide
auuagauagugcaucuucugaggua

SEQ ID NO: 1420 - RNA, 25 nt, Artificial Sequence
  synthetic polynucleotide
uuagauagugcaucuucugagguca

SEQ ID NO: 1421 - RNA, 25 nt, Artificial Sequence
  synthetic polynucleotide
gugcaucuucugaggucaauuaaaa

SEQ ID NO: 1422 - RNA, 25 nt, Artificial Sequence
  synthetic polynucleotide
ugcaucuucugaggucaauuaaaaa

SEQ ID NO: 1423 - RNA, 25 nt, Artificial Sequence
  synthetic polynucleotide
gcaucuucugaggucaauuaaaaga

SEQ ID NO: 1424 - RNA, 25 nt, Artificial Sequence
  synthetic polynucleotide
caucuucugaggucaauuaaaagga

SEQ ID NO: 1425 - RNA, 25 nt, Artificial Sequence
  synthetic polynucleotide
aucuucugaggucaauuaaaaggaa

SEQ ID NO: 1426 - RNA, 25 nt, Artificial Sequence
  synthetic polynucleotide
ucuucugaggucaauuaaaaggaga

SEQ ID NO: 1427 - RNA, 25 nt, Artificial Sequence
  synthetic polynucleotide
cuucugaggucaauuaaaaggagaa

SEQ ID NO: 1428 - RNA, 25 nt, Artificial Sequence
  synthetic polynucleotide
aaaaaauacaauuucucacuuugca

SEQ ID NO: 1429 - RNA, 25 nt, Artificial Sequence
  synthetic polynucleotide
aaaauacaauuucucacuuugcauu

SEQ ID NO: 1430 - RNA, 25 nt, Artificial Sequence
  synthetic polynucleotide
auacaauuucucacuuugcauuuag

SEQ ID NO: 1431 - RNA, 25 nt, Artificial Sequence
  synthetic polynucleotide
uacaauuucucacuuugcauuuagu

SEQ ID NO: 1432 - RNA, 25 nt, Artificial Sequence
  synthetic polynucleotide
acaauuucucacuuugcauuuaguc

SEQ ID NO: 1433 - RNA, 25 nt, Artificial Sequence
  synthetic polynucleotide
caauuucucacuuugcauuuaguca

SEQ ID NO: 1434 - RNA, 25 nt, Artificial Sequence
  synthetic polynucleotide
uucucacuuugcauuuagucaaaag

SEQ ID NO: 1435 - RNA, 25 nt, Artificial Sequence
  synthetic polynucleotide
gcuuuauagcaaaaugaaagagaac

SEQ ID NO: 1436 - RNA, 25 nt, Artificial Sequence
  synthetic polynucleotide
uuuauagcaaaaugaaagagaacau

SEQ ID NO: 1437 - RNA, 25 nt, Artificial Sequence
  synthetic polynucleotide
uuauagcaaaaugaaagagaacaug

SEQ ID NO: 1438 - RNA, 25 nt, Artificial Sequence
  synthetic polynucleotide
aacaugaaaugcuucuuucucaguu

SEQ ID NO: 1439 - RNA, 25 nt, Artificial Sequence
  synthetic polynucleotide
acaugaaaugcuucuuucucaguuu

SEQ ID NO: 1440 - RNA, 25 nt, Artificial Sequence
  synthetic polynucleotide
augaaaugcuucuuucucaguuuau

SEQ ID NO: 1441 - RNA, 25 nt, Artificial Sequence
  synthetic polynucleotide
aaaugcuucuuucucaguuuauugg

SEQ ID NO: 1442 - RNA, 25 nt, Artificial Sequence
  synthetic polynucleotide
aaugcuucuuucucaguuuauuggu

SEQ ID NO: 1443 - RNA, 25 nt, Artificial Sequence
  synthetic polynucleotide
ugcuucuuucucaguuuauugguug

SEQ ID NO: 1444 - RNA, 25 nt, Artificial Sequence
  synthetic polynucleotide
gcuucuuucucaguuuauugguuga

SEQ ID NO: 1445 - RNA, 25 nt, Artificial Sequence
  synthetic polynucleotide
cuucuuucucaguuuauugguugaa

SEQ ID NO: 1446 - RNA, 25 nt, Artificial Sequence
  synthetic polynucleotide
uucuuucucaguuuauugguugaau

SEQ ID NO: 1447 - RNA, 25 nt, Artificial Sequence
  synthetic polynucleotide
aguuuauugguugaauguguaucua

SEQ ID NO: 1448 - RNA, 25 nt, Artificial Sequence
  synthetic polynucleotide
uugaauguguaucuauuugagucug

SEQ ID NO: 1449 - RNA, 25 nt, Artificial Sequence
  synthetic polynucleotide
ugaauguguaucuauuugagucugg

SEQ ID NO: 1450 - RNA, 25 nt, Artificial Sequence
  synthetic polynucleotide
uguguaucuauuugagucuggaaau

SEQ ID NO: 1451 - RNA, 25 nt, Artificial Sequence
  synthetic polynucleotide
guguaucuauuugagucuggaaaua

SEQ ID NO: 1452 - RNA, 25 nt, Artificial Sequence
  synthetic polynucleotide
guaucuauuugagucuggaaauaac

SEQ ID NO: 1453 - RNA, 25 nt, Artificial Sequence
  synthetic polynucleotide
uauuugagucuggaaauaacuaaug

SEQ ID NO: 1454 - RNA, 25 nt, Artificial Sequence
  synthetic polynucleotide
uuugauaauuaguuuaguuuguggc

SEQ ID NO: 1455 - RNA, 25 nt, Artificial Sequence
  synthetic polynucleotide
uugauaauuaguuuaguuuguggcu

SEQ ID NO: 1456 - RNA, 25 nt, Artificial Sequence
  synthetic polynucleotide
auaauuaguuuaguuuguggcuuca

SEQ ID NO: 1457 - RNA, 25 nt, Artificial Sequence
  synthetic polynucleotide
aauuaguuuaguuuguggcuucaug

SEQ ID NO: 1458 - RNA, 25 nt, Artificial Sequence
  synthetic polynucleotide
auuaguuuaguuuguggcuucaugg

SEQ ID NO: 1459 - RNA, 25 nt, Artificial Sequence
  synthetic polynucleotide
uuaguuuaguuuguggcuucaugga

SEQ ID NO: 1460 - RNA, 25 nt, Artificial Sequence
  synthetic polynucleotide
uaguuuaguuuguggcuucauggaa

SEQ ID NO: 1461 - RNA, 25 nt, Artificial Sequence
  synthetic polynucleotide
ucauggaaacucccuguaaacuaaa

SEQ ID NO: 1462 - RNA, 25 nt, Artificial Sequence
  synthetic polynucleotide
cauggaaacucccuguaaacuaaaa

SEQ ID NO: 1463 - RNA, 25 nt, Artificial Sequence
  synthetic polynucleotide
auggaaacucccuguaaacuaaaag

SEQ ID NO: 1464 - RNA, 25 nt, Artificial Sequence
  synthetic polynucleotide
uggaaacucccuguaaacuaaaagc

SEQ ID NO: 1465 - RNA, 25 nt, Artificial Sequence
  synthetic polynucleotide
ggaaacucccuguaaacuaaaagcu

SEQ ID NO: 1466 - RNA, 25 nt, Artificial Sequence
  synthetic polynucleotide
gaaacucccuguaaacuaaaagcuu

SEQ ID NO: 1467 - RNA, 25 nt, Artificial Sequence
  synthetic polynucleotide
aacucccuguaaacuaaaagcuuca

SEQ ID NO: 1468 - RNA, 25 nt, Artificial Sequence
  synthetic polynucleotide
cucccuguaaacuaaaagcuucagg

SEQ ID NO: 1469 - RNA, 25 nt, Artificial Sequence
  synthetic polynucleotide
uauguucauucuauagaagaaaugc

SEQ ID NO: 1470 - RNA, 25 nt, Artificial Sequence
  synthetic polynucleotide
uucuauagaagaaaugcaaacuauc

SEQ ID NO: 1471 - RNA, 25 nt, Artificial Sequence
  synthetic polynucleotide
ucuauagaagaaaugcaaacuauca

SEQ ID NO: 1472 - RNA, 25 nt, Artificial Sequence
  synthetic polynucleotide
cuauagaagaaaugcaaacuaucac

SEQ ID NO: 1473 - RNA, 25 nt, Artificial Sequence
  synthetic polynucleotide
uauagaagaaaugcaaacuaucacu

SEQ ID NO: 1474 - RNA, 25 nt, Artificial Sequence
  synthetic polynucleotide
uagaagaaaugcaaacuaucacugu

SEQ ID NO: 1475 - RNA, 25 nt, Artificial Sequence
  synthetic polynucleotide
aagaaaugcaaacuaucacuguauu

SEQ ID NO: 1476 - RNA, 25 nt, Artificial Sequence
  synthetic polynucleotide
agaaaugcaaacuaucacuguauuu

SEQ ID NO: 1477 - RNA, 25 nt, Artificial Sequence
  synthetic polynucleotide
auuuauguagaagcaaacaaaauac

SEQ ID NO: 1478 - RNA, 25 nt, Artificial Sequence
  synthetic polynucleotide
uaucuuuuuguggugugaauaaauc

SEQ ID NO: 1479 - RNA, 25 nt, Artificial Sequence
  synthetic polynucleotide
aucuuuuuguggugugaauaaaucu

SEQ ID NO: 1480 - RNA, 25 nt, Artificial Sequence
  synthetic polynucleotide
ucuuuuuguggugugaauaaaucuu

SEQ ID NO: 1481 - RNA, 25 nt, Artificial Sequence
  synthetic polynucleotide
cuuuuuguggugugaauaaaucuuu

SEQ ID NO: 1482 - RNA, 25 nt, Artificial Sequence
  synthetic polynucleotide
cuugaauguaauaagaauuuggugg

SEQ ID NO: 1483 - RNA, 25 nt, Artificial Sequence
  synthetic polynucleotide
uugaauguaauaagaauuugguggu

SEQ ID NO: 1484 - RNA, 25 nt, Artificial Sequence
  synthetic polynucleotide
uaauaagaauuugguggugucaauu

SEQ ID NO: 1485 - RNA, 25 nt, Artificial Sequence
  synthetic polynucleotide
aauuugguggugucaauugcuuauu

SEQ ID NO: 1486 - RNA, 25 nt, Artificial Sequence
  synthetic polynucleotide
auuugguggugucaauugcuuauuu

SEQ ID NO: 1487 - RNA, 25 nt, Artificial Sequence
  synthetic polynucleotide
uuugguggugucaauugcuuauuug

SEQ ID NO: 1488 - RNA, 25 nt, Artificial Sequence
  synthetic polynucleotide
uugguggugucaauugcuuauuugu

SEQ ID NO: 1489 - RNA, 25 nt, Artificial Sequence
  synthetic polynucleotide
uucccacgguuguccagcaauuaau

SEQ ID NO: 1490 - RNA, 13 nt, Artificial Sequence
  synthetic polynucleotide
acauuaacucaua

SEQ ID NO: 1491 - RNA, 19 nt, Artificial Sequence
  synthetic polynucleotide
uaugaguuaaugucucuca

SEQ ID NO: 1492 - RNA, 14 nt, Artificial Sequence
  synthetic polynucleotide
gacauuaacucaua

SEQ ID NO: 1493 - RNA, 19 nt, Artificial Sequence
  synthetic polynucleotide
uaugaguuaaugucucuca

SEQ ID NO: 1494 - RNA, 13 nt, Artificial Sequence
  synthetic polynucleotide
ugaagaauguuaa

SEQ ID NO: 1495 - RNA, 19 nt, Artificial Sequence
  synthetic polynucleotide
uuaacauucuucaaaccag

SEQ ID NO: 1496 - RNA, 14 nt, Artificial Sequence
  synthetic polynucleotide
uugaagaauguuaa

SEQ ID NO: 1497 - RNA, 19 nt, Artificial Sequence
  synthetic polynucleotide
uuaacauucuucaaaccag

SEQ ID NO: 1498 - RNA, 13 nt, Artificial Sequence
  synthetic polynucleotide
gauagcaucuuaa

SEQ ID NO: 1499 - RNA, 19 nt, Artificial Sequence
  synthetic polynucleotide
uuaagaugcuaucugauga

SEQ ID NO: 1500 - RNA, 14 nt, Artificial Sequence
  synthetic polynucleotide
agauagcaucuuaa

SEQ ID NO: 1501 - RNA, 19 nt, Artificial Sequence
  synthetic polynucleotide
uuaagaugcuaucugauga

SEQ ID NO: 1502 - RNA, 13 nt, Artificial Sequence
  synthetic polynucleotide
ugaaguguaauua

SEQ ID NO: 1503 - RNA, 19 nt, Artificial Sequence
  synthetic polynucleotide
uaauuacacuucaaauagc

SEQ ID NO: 1504 - RNA, 13 nt, Artificial Sequence
  synthetic polynucleotide
aauugagaaggaa

SEQ ID NO: 1505 - RNA, 19 nt, Artificial Sequence
  synthetic polynucleotide
uuccuucucaauuacacuu

SEQ ID NO: 1506 - RNA, 13 nt, Artificial Sequence
  synthetic polynucleotide
uugagaaggaaaa

SEQ ID NO: 1507 - RNA, 19 nt, Artificial Sequence
  synthetic polynucleotide
uuuuccuucucaauuacac

SEQ ID NO: 1508 - RNA, 13 nt, Artificial Sequence
  synthetic polynucleotide
cauucugauucga

SEQ ID NO: 1509 - RNA, 19 nt, Artificial Sequence
  synthetic polynucleotide
ucgaaucagaaugucagag

SEQ ID NO: 1510 - RNA, 13 nt, Artificial Sequence
  synthetic polynucleotide
uucugauucgaaa

SEQ ID NO: 1511 - RNA, 19 nt, Artificial Sequence
  synthetic polynucleotide
uuucgaaucagaaugucag

SEQ ID NO: 1512 - RNA, 13 nt, Artificial Sequence
  synthetic polynucleotide
cugucgauuagaa

SEQ ID NO: 1513 - RNA, 19 nt, Artificial Sequence
  synthetic polynucleotide
uucuaaucgacaggauucc

SEQ ID NO: 1514 - RNA, 13 nt, Artificial Sequence
  synthetic polynucleotide
uuugccuguaaca

SEQ ID NO: 1515 - RNA, 19 nt, Artificial Sequence
  synthetic polynucleotide
uguuacaggcaaauucacu

SEQ ID NO: 1516 - RNA, 14 nt, Artificial Sequence
  synthetic polynucleotide
auuugccuguaaca

SEQ ID NO: 1517 - RNA, 19 nt, Artificial Sequence
  synthetic polynucleotide
uguuacaggcaaauucacu

SEQ ID NO: 1518 - RNA, 13 nt, Artificial Sequence
  synthetic polynucleotide
acaagccagauua

SEQ ID NO: 1519 - RNA, 19 nt, Artificial Sequence
  synthetic polynucleotide
uaaucuggcuuguuacagg

SEQ ID NO: 1520 - RNA, 14 nt, Artificial Sequence
  synthetic polynucleotide
aacaagccagauua

SEQ ID NO: 1521 - RNA, 19 nt, Artificial Sequence
  synthetic polynucleotide
uaaucuggcuuguuacagg

SEQ ID NO: 1522 - RNA, 13 nt, Artificial Sequence
  synthetic polynucleotide
caguuuauuugua

SEQ ID NO: 1523 - RNA, 19 nt, Artificial Sequence
  synthetic polynucleotide
uacaaauaaacuguccgaa

SEQ ID NO: 1524 - RNA, 13 nt, Artificial Sequence
  synthetic polynucleotide
uguugagagugua

SEQ ID NO: 1525 - RNA, 19 nt, Artificial Sequence
  synthetic polynucleotide
uacacucucaacaaauaaa

SEQ ID NO: 1526 - RNA, 14 nt, Artificial Sequence
  synthetic polynucleotide
uuguugagagugua

SEQ ID NO: 1527 - RNA, 19 nt, Artificial Sequence
  synthetic polynucleotide
uacacucucaacaaauaaa

SEQ ID NO: 1528 - RNA, 13 nt, Artificial Sequence
  synthetic polynucleotide
ugcaccuuucuaa

SEQ ID NO: 1529 - RNA, 19 nt, Artificial Sequence
  synthetic polynucleotide
uuagaaaggugcaaacaug

SEQ ID NO: 1530 - RNA, 14 nt, Artificial Sequence
  synthetic polynucleotide
uugcaccuuucuaa

SEQ ID NO: 1531 - RNA, 19 nt, Artificial Sequence
  synthetic polynucleotide
uuagaaaggugcaaacaug

SEQ ID NO: 1532 - RNA, 13 nt, Artificial Sequence
  synthetic polynucleotide
uugagcuuucuga

SEQ ID NO: 1533 - RNA, 19 nt, Artificial Sequence
  synthetic polynucleotide
ucagaaagcucaaacuuga

SEQ ID NO: 1534 - RNA, 13 nt, Artificial Sequence
  synthetic polynucleotide
ugagagugugaca

SEQ ID NO: 1535 - RNA, 19 nt, Artificial Sequence
  synthetic polynucleotide
ugucacacucucaacaaau

SEQ ID NO: 1536 - RNA, 13 nt, Artificial Sequence
  synthetic polynucleotide
agugugaccaaaa

SEQ ID NO: 1537 - RNA, 19 nt, Artificial Sequence
  synthetic polynucleotide
uuuuggucacacucucaac

SEQ ID NO: 1538 - RNA, 14 nt, Artificial Sequence
  synthetic polynucleotide
gagugugaccaaaa

SEQ ID NO: 1539 - RNA, 19 nt, Artificial Sequence
  synthetic polynucleotide
uuuuggucacacucucaac

SEQ ID NO: 1540 - RNA, 13 nt, Artificial Sequence
  synthetic polynucleotide
gugugaccaaaaa

SEQ ID NO: 1541 - RNA, 19 nt, Artificial Sequence
  synthetic polynucleotide
uuuuuggucacacucucaa

SEQ ID NO: 1542 - RNA, 13 nt, Artificial Sequence
  synthetic polynucleotide
ugugaccaaaaga

SEQ ID NO: 1543 - RNA, 19 nt, Artificial Sequence
  synthetic polynucleotide
ucuuuuggucacacucuca

SEQ ID NO: 1544 - RNA, 14 nt, Artificial Sequence
  synthetic polynucleotide
gugugaccaaaaga

SEQ ID NO: 1545 - RNA, 19 nt, Artificial Sequence
  synthetic polynucleotide
ucuuuuggucacacucuca

SEQ ID NO: 1546 - RNA, 13 nt, Artificial Sequence
  synthetic polynucleotide
gugaccaaaagua

SEQ ID NO: 1547 - RNA, 19 nt, Artificial Sequence
  synthetic polynucleotide
uacuuuuggucacacucuc

SEQ ID NO: 1548 - RNA, 13 nt, Artificial Sequence
  synthetic polynucleotide
gaccaaaaguuaa

SEQ ID NO: 1549 - RNA, 19 nt, Artificial Sequence
  synthetic polynucleotide
uuaacuuuuggucacacuc

SEQ ID NO: 1550 - RNA, 13 nt, Artificial Sequence
  synthetic polynucleotide
gcaccuuucuaga

SEQ ID NO: 1551 - RNA, 19 nt, Artificial Sequence
  synthetic polynucleotide
ucuagaaaggugcaaacau

SEQ ID NO: 1552 - RNA, 13 nt, Artificial Sequence
  synthetic polynucleotide
ccuuucuaguuga

SEQ ID NO: 1553 - RNA, 19 nt, Artificial Sequence
  synthetic polynucleotide
ucaacuagaaaggugcaaa

SEQ ID NO: 1554 - RNA, 25 nt, Artificial Sequence
  synthetic polynucleotide
uuuggcccagacccaacuaugauua

SEQ ID NO: 1555 - RNA, 25 nt, Artificial Sequence
  synthetic polynucleotide
uggcccagacccaacuaugauuaga

SEQ ID NO: 1556 - RNA, 25 nt, Artificial Sequence
  synthetic polynucleotide
cccaacuaugauuagagccaacuga

SEQ ID NO: 1557 - RNA, 25 nt, Artificial Sequence
  synthetic polynucleotide
ccaacuaugauuagagccaacugca

SEQ ID NO: 1558 - RNA, 25 nt, Artificial Sequence
  synthetic polynucleotide
cuugcgaagcugaccuggaagagaa

SEQ ID NO: 1559 - RNA, 25 nt, Artificial Sequence
  synthetic polynucleotide
cgaagcugaccuggaagagaacaua

SEQ ID NO: 1560 - RNA, 25 nt, Artificial Sequence
  synthetic polynucleotide
aagcugaccuggaagagaacauuaa

SEQ ID NO: 1561 - RNA, 25 nt, Artificial Sequence
  synthetic polynucleotide
agcugaccuggaagagaacauuaaa

SEQ ID NO: 1562 - RNA, 25 nt, Artificial Sequence
  synthetic polynucleotide
cugaccuggaagagaacauuaagaa

SEQ ID NO: 1563 - RNA, 25 nt, Artificial Sequence
  synthetic polynucleotide
ugaccuggaagagaacauuaagaaa

SEQ ID NO: 1564 - RNA, 25 nt, Artificial Sequence
  synthetic polynucleotide
gaccuggaagagaacauuaagaaga

SEQ ID NO: 1565 - RNA, 25 nt, Artificial Sequence
  synthetic polynucleotide
ccguacucccaaaaucuccaagcca

SEQ ID NO: 1566 - RNA, 25 nt, Artificial Sequence
  synthetic polynucleotide
cguacucccaaaaucuccaagccua

SEQ ID NO: 1567 - RNA, 25 nt, Artificial Sequence
  synthetic polynucleotide
guacucccaaaaucuccaagccuaa

SEQ ID NO: 1568 - RNA, 25 nt, Artificial Sequence
  synthetic polynucleotide
uacucccaaaaucuccaagccuaua

SEQ ID NO: 1569 - RNA, 25 nt, Artificial Sequence
  synthetic polynucleotide
acucccaaaaucuccaagccuauca

SEQ ID NO: 1570 - RNA, 25 nt, Artificial Sequence
  synthetic polynucleotide
cucccaaaaucuccaagccuaucaa

SEQ ID NO: 1571 - RNA, 25 nt, Artificial Sequence
  synthetic polynucleotide
ucccaaaaucuccaagccuaucaaa

SEQ ID NO: 1572 - RNA, 25 nt, Artificial Sequence
  synthetic polynucleotide
cccaaaaucuccaagccuaucaaga

SEQ ID NO: 1573 - RNA, 25 nt, Artificial Sequence
  synthetic polynucleotide
aagccuaucaaguuugagcuuucua

SEQ ID NO: 1574 - RNA, 25 nt, Artificial Sequence
  synthetic polynucleotide
agccuaucaaguuugagcuuucuga

SEQ ID NO: 1575 - RNA, 25 nt, Artificial Sequence
  synthetic polynucleotide
gccuaucaaguuugagcuuucugga

SEQ ID NO: 1576 - RNA, 25 nt, Artificial Sequence
  synthetic polynucleotide
aucaaguuugagcuuucuggcugca

SEQ ID NO: 1577 - RNA, 25 nt, Artificial Sequence
  synthetic polynucleotide
uggcugcaccagcaugaagacauaa

SEQ ID NO: 1578 - RNA, 25 nt, Artificial Sequence
  synthetic polynucleotide
cugcaccagcaugaagacauaccga

SEQ ID NO: 1579 - RNA, 25 nt, Artificial Sequence
  synthetic polynucleotide
ugcaccagcaugaagacauaccgaa

SEQ ID NO: 1580 - RNA, 25 nt, Artificial Sequence
  synthetic polynucleotide
ccagcaugaagacauaccgagcuaa

SEQ ID NO: 1581 - RNA, 25 nt, Artificial Sequence
  synthetic polynucleotide
agcaugaagacauaccgagcuaaaa

SEQ ID NO: 1582 - RNA, 25 nt, Artificial Sequence
  synthetic polynucleotide
gcaugaagacauaccgagcuaaaua

SEQ ID NO: 1583 - RNA, 25 nt, Artificial Sequence
  synthetic polynucleotide
cgagcuaaauucuguggaguaugua

SEQ ID NO: 1584 - RNA, 25 nt, Artificial Sequence
  synthetic polynucleotide
gagcuaaauucuguggaguauguaa

SEQ ID NO: 1585 - RNA, 25 nt, Artificial Sequence
  synthetic polynucleotide
gcuaaauucuguggaguauguacca

SEQ ID NO: 1586 - RNA, 25 nt, Artificial Sequence
  synthetic polynucleotide
cuaaauucuguggaguauguaccga

SEQ ID NO: 1587 - RNA, 25 nt, Artificial Sequence
  synthetic polynucleotide
cugacggcgaggucaugaagaagaa

SEQ ID NO: 1588 - RNA, 25 nt, Artificial Sequence
  synthetic polynucleotide
acggcgaggucaugaagaagaacaa

SEQ ID NO: 1589 - RNA, 25 nt, Artificial Sequence
  synthetic polynucleotide
cggcgaggucaugaagaagaacaua

SEQ ID NO: 1590 - RNA, 25 nt, Artificial Sequence
  synthetic polynucleotide
gaggucaugaagaagaacaugauga

SEQ ID NO: 1591 - RNA, 25 nt, Artificial Sequence
  synthetic polynucleotide
ggucaugaagaagaacaugauguua

SEQ ID NO: 1592 - RNA, 25 nt, Artificial Sequence
  synthetic polynucleotide
caugaagaagaacaugauguucaua

SEQ ID NO: 1593 - RNA, 25 nt, Artificial Sequence
  synthetic polynucleotide
gaacaugauguucaucaagaccuga

SEQ ID NO: 1594 - RNA, 25 nt, Artificial Sequence
  synthetic polynucleotide
augauguucaucaagaccugugcca

SEQ ID NO: 1595 - RNA, 25 nt, Artificial Sequence
  synthetic polynucleotide
ggagacaaugacaucuuugaaucga

SEQ ID NO: 1596 - RNA, 25 nt, Artificial Sequence
  synthetic polynucleotide
gagacaaugacaucuuugaaucgca

SEQ ID NO: 1597 - RNA, 25 nt, Artificial Sequence
  synthetic polynucleotide
agacaaugacaucuuugaaucgcua

SEQ ID NO: 1598 - RNA, 25 nt, Artificial Sequence
  synthetic polynucleotide
gacaaugacaucuuugaaucgcuga

SEQ ID NO: 1599 - RNA, 25 nt, Artificial Sequence
  synthetic polynucleotide
acaaugacaucuuugaaucgcugua

SEQ ID NO: 1600 - RNA, 25 nt, Artificial Sequence
  synthetic polynucleotide
caaugacaucuuugaaucgcuguaa

SEQ ID NO: 1601 - RNA, 25 nt, Artificial Sequence
  synthetic polynucleotide
aaugacaucuuugaaucgcuguaca

SEQ ID NO: 1602 - RNA, 25 nt, Artificial Sequence
  synthetic polynucleotide
augacaucuuugaaucgcuguacua

SEQ ID NO: 1603 - RNA, 25 nt, Artificial Sequence
  synthetic polynucleotide
ugacaucuuugaaucgcuguacuaa

SEQ ID NO: 1604 - RNA, 25 nt, Artificial Sequence
  synthetic polynucleotide
gacaucuuugaaucgcuguacuaca

SEQ ID NO: 1605 - RNA, 25 nt, Artificial Sequence
  synthetic polynucleotide
acaucuuugaaucgcuguacuacaa

SEQ ID NO: 1606 - RNA, 25 nt, Artificial Sequence
  synthetic polynucleotide
ucuuugaaucgcuguacuacaggaa

SEQ ID NO: 1607 - RNA, 25 nt, Artificial Sequence
  synthetic polynucleotide
cuuugaaucgcuguacuacaggaaa

SEQ ID NO: 1608 - RNA, 25 nt, Artificial Sequence
  synthetic polynucleotide
aucgcuguacuacaggaagauguaa

SEQ ID NO: 1609 - RNA, 25 nt, Artificial Sequence
  synthetic polynucleotide
ucgcuguacuacaggaagauguaca

SEQ ID NO: 1610 - RNA, 25 nt, Artificial Sequence
  synthetic polynucleotide
aagauguacggagacauggcaugaa

SEQ ID NO: 1611 - RNA, 25 nt, Artificial Sequence
  synthetic polynucleotide
cauggcaugaagccagagagugaga

SEQ ID NO: 1612 - RNA, 25 nt, Artificial Sequence
  synthetic polynucleotide
cagagagugagagacauuaacucaa

SEQ ID NO: 1613 - RNA, 25 nt, Artificial Sequence
  synthetic polynucleotide
agagagugagagacauuaacucaua

SEQ ID NO: 1614 - RNA, 25 nt, Artificial Sequence
  synthetic polynucleotide
gagagugagagacauuaacucauua

SEQ ID NO: 1615 - RNA, 25 nt, Artificial Sequence
  synthetic polynucleotide
agagugagagacauuaacucauuaa

SEQ ID NO: 1616 - RNA, 25 nt, Artificial Sequence
  synthetic polynucleotide
gagugagagacauuaacucauuaga

SEQ ID NO: 1617 - RNA, 25 nt, Artificial Sequence
  synthetic polynucleotide
agugagagacauuaacucauuagaa

SEQ ID NO: 1618 - RNA, 25 nt, Artificial Sequence
  synthetic polynucleotide
gugagagacauuaacucauuagaca

SEQ ID NO: 1619 - RNA, 25 nt, Artificial Sequence
  synthetic polynucleotide
ugagagacauuaacucauuagacua

SEQ ID NO: 1620 - RNA, 25 nt, Artificial Sequence
  synthetic polynucleotide
agagacauuaacucauuagacugga

SEQ ID NO: 1621 - RNA, 25 nt, Artificial Sequence
  synthetic polynucleotide
agacauuaacucauuagacuggaaa

SEQ ID NO: 1622 - RNA, 25 nt, Artificial Sequence
  synthetic polynucleotide
gacauuaacucauuagacuggaaca

SEQ ID NO: 1623 - RNA, 25 nt, Artificial Sequence
  synthetic polynucleotide
acauuaacucauuagacuggaacua

SEQ ID NO: 1624 - RNA, 25 nt, Artificial Sequence
  synthetic polynucleotide
auuaacucauuagacuggaacuuga

SEQ ID NO: 1625 - RNA, 25 nt, Artificial Sequence
  synthetic polynucleotide
aacucauuagacuggaacuugaaca

SEQ ID NO: 1626 - RNA, 25 nt, Artificial Sequence
  synthetic polynucleotide
acucauuagacuggaacuugaacua

SEQ ID NO: 1627 - RNA, 25 nt, Artificial Sequence
  synthetic polynucleotide
cucauuagacuggaacuugaacuga

SEQ ID NO: 1628 - RNA, 25 nt, Artificial Sequence
  synthetic polynucleotide
ucauuagacuggaacuugaacugaa

SEQ ID NO: 1629 - RNA, 25 nt, Artificial Sequence
  synthetic polynucleotide
uagacuggaacuugaacugauucaa

SEQ ID NO: 1630 - RNA, 25 nt, Artificial Sequence
  synthetic polynucleotide
gacuggaacuugaacugauucacaa

SEQ ID NO: 1631 - RNA, 25 nt, Artificial Sequence
  synthetic polynucleotide
acuggaacuugaacugauucacaua

SEQ ID NO: 1632 - RNA, 25 nt, Artificial Sequence
  synthetic polynucleotide
cuggaacuugaacugauucacauca

SEQ ID NO: 1633 - RNA, 25 nt, Artificial Sequence
  synthetic polynucleotide
uggaacuugaacugauucacaucua

SEQ ID NO: 1634 - RNA, 25 nt, Artificial Sequence
  synthetic polynucleotide
gaacuugaacugauucacaucucaa

SEQ ID NO: 1635 - RNA, 25 nt, Artificial Sequence
  synthetic polynucleotide
aacuugaacugauucacaucucaua

SEQ ID NO: 1636 - RNA, 25 nt, Artificial Sequence
  synthetic polynucleotide
acuugaacugauucacaucucauua

SEQ ID NO: 1637 - RNA, 25 nt, Artificial Sequence
  synthetic polynucleotide
cuugaacugauucacaucucauuua

SEQ ID NO: 1638 - RNA, 25 nt, Artificial Sequence
  synthetic polynucleotide
uccguaaaaaugauuucaguagcaa

SEQ ID NO: 1639 - RNA, 25 nt, Artificial Sequence
  synthetic polynucleotide
aaaaugauuucaguagcacaaguua

SEQ ID NO: 1640 - RNA, 25 nt, Artificial Sequence
  synthetic polynucleotide
cccaauucaaaacauugugccauga

SEQ ID NO: 1641 - RNA, 25 nt, Artificial Sequence
  synthetic polynucleotide
caauucaaaacauugugccauguca

SEQ ID NO: 1642 - RNA, 25 nt, Artificial Sequence
  synthetic polynucleotide
caaaacauugugccaugucaaacaa

SEQ ID NO: 1643 - RNA, 25 nt, Artificial Sequence
  synthetic polynucleotide
auugugccaugucaaacaaauagua

SEQ ID NO: 1644 - RNA, 25 nt, Artificial Sequence
  synthetic polynucleotide
uugugccaugucaaacaaauaguca

SEQ ID NO: 1645 - RNA, 25 nt, Artificial Sequence
  synthetic polynucleotide
ugccaugucaaacaaauagucuaua

SEQ ID NO: 1646 - RNA, 25 nt, Artificial Sequence
  synthetic polynucleotide
augucaaacaaauagucuaucaaca

SEQ ID NO: 1647 - RNA, 25 nt, Artificial Sequence
  synthetic polynucleotide
ucaaccccagacacugguuugaaga

SEQ ID NO: 1648 - RNA, 25 nt, Artificial Sequence
  synthetic polynucleotide
caaccccagacacugguuugaagaa

SEQ ID NO: 1649 - RNA, 25 nt, Artificial Sequence
  synthetic polynucleotide
accccagacacugguuugaagaaua

SEQ ID NO: 1650 - RNA, 25 nt, Artificial Sequence
  synthetic polynucleotide
ccccagacacugguuugaagaauga

SEQ ID NO: 1651 - RNA, 25 nt, Artificial Sequence
  synthetic polynucleotide
cagacacugguuugaagaauguuaa

SEQ ID NO: 1652 - RNA, 25 nt, Artificial Sequence
  synthetic polynucleotide
ugguuugaagaauguuaagacuuga

SEQ ID NO: 1653 - RNA, 25 nt, Artificial Sequence
  synthetic polynucleotide
uugaagaauguuaagacuugacaga

SEQ ID NO: 1654 - RNA, 25 nt, Artificial Sequence
  synthetic polynucleotide
ugaagaauguuaagacuugacagua

SEQ ID NO: 1655 - RNA, 25 nt, Artificial Sequence
  synthetic polynucleotide
guuaagacuugacaguggaacuaca

SEQ ID NO: 1656 - RNA, 25 nt, Artificial Sequence
  synthetic polynucleotide
uugacaguggaacuacauuaguaca

SEQ ID NO: 1657 - RNA, 25 nt, Artificial Sequence
  synthetic polynucleotide
ugacaguggaacuacauuaguacaa

SEQ ID NO: 1658 - RNA, 25 nt, Artificial Sequence
  synthetic polynucleotide
caguggaacuacauuaguacacaga

SEQ ID NO: 1659 - RNA, 25 nt, Artificial Sequence
  synthetic polynucleotide
aguggaacuacauuaguacacagca

SEQ ID NO: 1660 - RNA, 25 nt, Artificial Sequence
  synthetic polynucleotide
guggaacuacauuaguacacagcaa

SEQ ID NO: 1661 - RNA, 25 nt, Artificial Sequence
  synthetic polynucleotide
uggaacuacauuaguacacagcaca

SEQ ID NO: 1662 - RNA, 25 nt, Artificial Sequence
  synthetic polynucleotide
ggaacuacauuaguacacagcacca

SEQ ID NO: 1663 - RNA, 25 nt, Artificial Sequence
  synthetic polynucleotide
gaacuacauuaguacacagcaccaa

SEQ ID NO: 1664 - RNA, 25 nt, Artificial Sequence
  synthetic polynucleotide
aacuacauuaguacacagcaccaga

SEQ ID NO: 1665 - RNA, 25 nt, Artificial Sequence
  synthetic polynucleotide
acuacauuaguacacagcaccagaa

SEQ ID NO: 1666 - RNA, 25 nt, Artificial Sequence
  synthetic polynucleotide
cuacauuaguacacagcaccagaaa

SEQ ID NO: 1667 - RNA, 25 nt, Artificial Sequence
  synthetic polynucleotide
uacauuaguacacagcaccagaaua

SEQ ID NO: 1668 - RNA, 25 nt, Artificial Sequence
  synthetic polynucleotide
acauuaguacacagcaccagaauga

SEQ ID NO: 1669 - RNA, 25 nt, Artificial Sequence
  synthetic polynucleotide
auuaguacacagcaccagaauguaa

SEQ ID NO: 1670 - RNA, 25 nt, Artificial Sequence
  synthetic polynucleotide
uuaguacacagcaccagaauguaua

SEQ ID NO: 1671 - RNA, 25 nt, Artificial Sequence
  synthetic polynucleotide
aguacacagcaccagaauguauaua

SEQ ID NO: 1672 - RNA, 25 nt, Artificial Sequence
  synthetic polynucleotide
guacacagcaccagaauguauauua

SEQ ID NO: 1673 - RNA, 25 nt, Artificial Sequence
  synthetic polynucleotide
gcaccagaauguauauuaaggugua

SEQ ID NO: 1674 - RNA, 25 nt, Artificial Sequence
  synthetic polynucleotide
gaauguauauuaagguguggcuuua

SEQ ID NO: 1675 - RNA, 25 nt, Artificial Sequence
  synthetic polynucleotide
aggguaccagcagaaagguuaguaa

SEQ ID NO: 1676 - RNA, 25 nt, Artificial Sequence
  synthetic polynucleotide
uaccagcagaaagguuaguaucaua

SEQ ID NO: 1677 - RNA, 25 nt, Artificial Sequence
  synthetic polynucleotide
accagcagaaagguuaguaucauca

SEQ ID NO: 1678 - RNA, 25 nt, Artificial Sequence
  synthetic polynucleotide
gcagaaagguuaguaucaucagaua

SEQ ID NO: 1679 - RNA, 25 nt, Artificial Sequence
  synthetic polynucleotide
uuaguaucaucagauagcaucuuaa

SEQ ID NO: 1680 - RNA, 25 nt, Artificial Sequence
  synthetic polynucleotide
ucuuauacgaguaauaugccugcua

SEQ ID NO: 1681 - RNA, 25 nt, Artificial Sequence
  synthetic polynucleotide
cuuauacgaguaauaugccugcuaa

SEQ ID NO: 1682 - RNA, 25 nt, Artificial Sequence
  synthetic polynucleotide
uauacgaguaauaugccugcuauua

SEQ ID NO: 1683 - RNA, 25 nt, Artificial Sequence
  synthetic polynucleotide
auacgaguaauaugccugcuauuua

SEQ ID NO: 1684 - RNA, 25 nt, Artificial Sequence
  synthetic polynucleotide
uacgaguaauaugccugcuauuuga

SEQ ID NO: 1685 - RNA, 25 nt, Artificial Sequence
  synthetic polynucleotide
acgaguaauaugccugcuauuugaa

SEQ ID NO: 1686 - RNA, 25 nt, Artificial Sequence
  synthetic polynucleotide
gaguaauaugccugcuauuugaaga

SEQ ID NO: 1687 - RNA, 25 nt, Artificial Sequence
  synthetic polynucleotide
aguaauaugccugcuauuugaagua

SEQ ID NO: 1688 - RNA, 25 nt, Artificial Sequence
  synthetic polynucleotide
guaauaugccugcuauuugaaguga

SEQ ID NO: 1689 - RNA, 25 nt, Artificial Sequence
  synthetic polynucleotide
uaauaugccugcuauuugaagugua

SEQ ID NO: 1690 - RNA, 25 nt, Artificial Sequence
  synthetic polynucleotide
auaugccugcuauuugaaguguaaa

SEQ ID NO: 1691 - RNA, 25 nt, Artificial Sequence
  synthetic polynucleotide
augccugcuauuugaaguguaauua

SEQ ID NO: 1692 - RNA, 25 nt, Artificial Sequence
  synthetic polynucleotide
ugcuauuugaaguguaauugagaaa

SEQ ID NO: 1693 - RNA, 25 nt, Artificial Sequence
  synthetic polynucleotide
uauuugaaguguaauugagaaggaa

SEQ ID NO: 1694 - RNA, 25 nt, Artificial Sequence
  synthetic polynucleotide
auuugaaguguaauugagaaggaaa

SEQ ID NO: 1695 - RNA, 25 nt, Artificial Sequence
  synthetic polynucleotide
uuugaaguguaauugagaaggaaaa

SEQ ID NO: 1696 - RNA, 25 nt, Artificial Sequence
  synthetic polynucleotide
guaauugagaaggaaaauuuuagca

SEQ ID NO: 1697 - RNA, 25 nt, Artificial Sequence
  synthetic polynucleotide
uaauugagaaggaaaauuuuagcga

SEQ ID NO: 1698 - RNA, 25 nt, Artificial Sequence
  synthetic polynucleotide
aauugagaaggaaaauuuuagcgua

SEQ ID NO: 1699 - RNA, 25 nt, Artificial Sequence
  synthetic polynucleotide
auugagaaggaaaauuuuagcguga

SEQ ID NO: 1700 - RNA, 25 nt, Artificial Sequence
  synthetic polynucleotide
uugagaaggaaaauuuuagcgugca

SEQ ID NO: 1701 - RNA, 25 nt, Artificial Sequence
  synthetic polynucleotide
ugagaaggaaaauuuuagcgugcua

SEQ ID NO: 1702 - RNA, 25 nt, Artificial Sequence
  synthetic polynucleotide
aggaaaauuuuagcgugcucacuga

SEQ ID NO: 1703 - RNA, 25 nt, Artificial Sequence
  synthetic polynucleotide
ccagugacagcuaggaugugcauua

SEQ ID NO: 1704 - RNA, 25 nt, Artificial Sequence
  synthetic polynucleotide
ugacagcuaggaugugcauucucca

SEQ ID NO: 1705 - RNA, 25 nt, Artificial Sequence
  synthetic polynucleotide
uccagccaucaagagacugagucaa

SEQ ID NO: 1706 - RNA, 25 nt, Artificial Sequence
  synthetic polynucleotide
agccaucaagagacugagucaagua

SEQ ID NO: 1707 - RNA, 25 nt, Artificial Sequence
  synthetic polynucleotide
gccaucaagagacugagucaaguua

SEQ ID NO: 1708 - RNA, 25 nt, Artificial Sequence
  synthetic polynucleotide
ccaucaagagacugagucaaguuga

SEQ ID NO: 1709 - RNA, 25 nt, Artificial Sequence
  synthetic polynucleotide
caucaagagacugagucaaguugua

SEQ ID NO: 1710 - RNA, 25 nt, Artificial Sequence
  synthetic polynucleotide
aucaagagacugagucaaguuguua

SEQ ID NO: 1711 - RNA, 25 nt, Artificial Sequence
  synthetic polynucleotide
ucaagagacugagucaaguuguuca

SEQ ID NO: 1712 - RNA, 25 nt, Artificial Sequence
  synthetic polynucleotide
caagagacugagucaaguuguucca

SEQ ID NO: 1713 - RNA, 25 nt, Artificial Sequence
  synthetic polynucleotide
aagagacugagucaaguuguuccua

SEQ ID NO: 1714 - RNA, 25 nt, Artificial Sequence
  synthetic polynucleotide
agagacugagucaaguuguuccuua

SEQ ID NO: 1715 - RNA, 25 nt, Artificial Sequence
  synthetic polynucleotide
agacugagucaaguuguuccuuaaa

SEQ ID NO: 1716 - RNA, 25 nt, Artificial Sequence
  synthetic polynucleotide
gacugagucaaguuguuccuuaaga

SEQ ID NO: 1717 - RNA, 25 nt, Artificial Sequence
  synthetic polynucleotide
acugagucaaguuguuccuuaagua

SEQ ID NO: 1718 - RNA, 25 nt, Artificial Sequence
  synthetic polynucleotide
guuguuccuuaagucagaacagcaa

SEQ ID NO: 1719 - RNA, 25 nt, Artificial Sequence
  synthetic polynucleotide
aacagcagacucagcucugacauua

SEQ ID NO: 1720 - RNA, 25 nt, Artificial Sequence
  synthetic polynucleotide
acagcagacucagcucugacauuca

SEQ ID NO: 1721 - RNA, 25 nt, Artificial Sequence
  synthetic polynucleotide
cagcagacucagcucugacauucua

SEQ ID NO: 1722 - RNA, 25 nt, Artificial Sequence
  synthetic polynucleotide
agcagacucagcucugacauucuga

SEQ ID NO: 1723 - RNA, 25 nt, Artificial Sequence
  synthetic polynucleotide
gcagacucagcucugacauucugaa

SEQ ID NO: 1724 - RNA, 25 nt, Artificial Sequence
  synthetic polynucleotide
cagacucagcucugacauucugaua

SEQ ID NO: 1725 - RNA, 25 nt, Artificial Sequence
  synthetic polynucleotide
acucagcucugacauucugauucga

SEQ ID NO: 1726 - RNA, 25 nt, Artificial Sequence
  synthetic polynucleotide
cucagcucugacauucugauucgaa

SEQ ID NO: 1727 - RNA, 25 nt, Artificial Sequence
  synthetic polynucleotide
ucagcucugacauucugauucgaaa

SEQ ID NO: 1728 - RNA, 25 nt, Artificial Sequence
  synthetic polynucleotide
cagcucugacauucugauucgaaua

SEQ ID NO: 1729 - RNA, 25 nt, Artificial Sequence
  synthetic polynucleotide
agcucugacauucugauucgaauga

SEQ ID NO: 1730 - RNA, 25 nt, Artificial Sequence
  synthetic polynucleotide
ucugacauucugauucgaaugacaa

SEQ ID NO: 1731 - RNA, 25 nt, Artificial Sequence
  synthetic polynucleotide
ugacauucugauucgaaugacacua

SEQ ID NO: 1732 - RNA, 25 nt, Artificial Sequence
  synthetic polynucleotide
gacauucugauucgaaugacacuga

SEQ ID NO: 1733 - RNA, 25 nt, Artificial Sequence
  synthetic polynucleotide
acauucugauucgaaugacacugua

SEQ ID NO: 1734 - RNA, 25 nt, Artificial Sequence
  synthetic polynucleotide
ucugauucgaaugacacuguucaga

SEQ ID NO: 1735 - RNA, 25 nt, Artificial Sequence
  synthetic polynucleotide
cugauucgaaugacacuguucagga

SEQ ID NO: 1736 - RNA, 25 nt, Artificial Sequence
  synthetic polynucleotide
gauucgaaugacacuguucaggaaa

SEQ ID NO: 1737 - RNA, 25 nt, Artificial Sequence
  synthetic polynucleotide
auucgaaugacacuguucaggaaua

SEQ ID NO: 1738 - RNA, 25 nt, Artificial Sequence
  synthetic polynucleotide
gacacuguucaggaaucggaaucca

SEQ ID NO: 1739 - RNA, 25 nt, Artificial Sequence
  synthetic polynucleotide
acacuguucaggaaucggaauccua

SEQ ID NO: 1740 - RNA, 25 nt, Artificial Sequence
  synthetic polynucleotide
cacuguucaggaaucggaauccuga

SEQ ID NO: 1741 - RNA, 25 nt, Artificial Sequence
  synthetic polynucleotide
caggaaucggaauccugucgauuaa

SEQ ID NO: 1742 - RNA, 25 nt, Artificial Sequence
  synthetic polynucleotide
aggaaucggaauccugucgauuaga

SEQ ID NO: 1743 - RNA, 25 nt, Artificial Sequence
  synthetic polynucleotide
ggaaucggaauccugucgauuagaa

SEQ ID NO: 1744 - RNA, 25 nt, Artificial Sequence
  synthetic polynucleotide
gaaucggaauccugucgauuagaca

SEQ ID NO: 1745 - RNA, 25 nt, Artificial Sequence
  synthetic polynucleotide
aaucggaauccugucgauuagacua

SEQ ID NO: 1746 - RNA, 25 nt, Artificial Sequence
  synthetic polynucleotide
ucggaauccugucgauuagacugga

SEQ ID NO: 1747 - RNA, 25 nt, Artificial Sequence
  synthetic polynucleotide
gaauccugucgauuagacuggacaa

SEQ ID NO: 1748 - RNA, 25 nt, Artificial Sequence
  synthetic polynucleotide
cugucgauuagacuggacagcuuga

SEQ ID NO: 1749 - RNA, 25 nt, Artificial Sequence
  synthetic polynucleotide
ugucgauuagacuggacagcuugua

SEQ ID NO: 1750 - RNA, 25 nt, Artificial Sequence
  synthetic polynucleotide
gacagcuuguggcaagugaauuuga

SEQ ID NO: 1751 - RNA, 25 nt, Artificial Sequence
  synthetic polynucleotide
acagcuuguggcaagugaauuugca

SEQ ID NO: 1752 - RNA, 25 nt, Artificial Sequence
  synthetic polynucleotide
agcuuguggcaagugaauuugccua

SEQ ID NO: 1753 - RNA, 25 nt, Artificial Sequence
  synthetic polynucleotide
gcuuguggcaagugaauuugccuga

SEQ ID NO: 1754 - RNA, 25 nt, Artificial Sequence
  synthetic polynucleotide
cuuguggcaagugaauuugccugua

SEQ ID NO: 1755 - RNA, 25 nt, Artificial Sequence
  synthetic polynucleotide
uuguggcaagugaauuugccuguaa

SEQ ID NO: 1756 - RNA, 25 nt, Artificial Sequence
  synthetic polynucleotide
uguggcaagugaauuugccuguaaa

SEQ ID NO: 1757 - RNA, 25 nt, Artificial Sequence
  synthetic polynucleotide
guggcaagugaauuugccuguaaca

SEQ ID NO: 1758 - RNA, 25 nt, Artificial Sequence
  synthetic polynucleotide
uggcaagugaauuugccuguaacaa

SEQ ID NO: 1759 - RNA, 25 nt, Artificial Sequence
  synthetic polynucleotide
ggcaagugaauuugccuguaacaaa

SEQ ID NO: 1760 - RNA, 25 nt, Artificial Sequence
  synthetic polynucleotide
gcaagugaauuugccuguaacaaga

SEQ ID NO: 1761 - RNA, 25 nt, Artificial Sequence
  synthetic polynucleotide
caagugaauuugccuguaacaagca

SEQ ID NO: 1762 - RNA, 25 nt, Artificial Sequence
  synthetic polynucleotide
aagugaauuugccuguaacaagcca

SEQ ID NO: 1763 - RNA, 25 nt, Artificial Sequence
  synthetic polynucleotide
agugaauuugccuguaacaagccaa

SEQ ID NO: 1764 - RNA, 25 nt, Artificial Sequence
  synthetic polynucleotide
gaauuugccuguaacaagccagaua

SEQ ID NO: 1765 - RNA, 25 nt, Artificial Sequence
  synthetic polynucleotide
aauuugccuguaacaagccagauua

SEQ ID NO: 1766 - RNA, 25 nt, Artificial Sequence
  synthetic polynucleotide
auuugccuguaacaagccagauuua

SEQ ID NO: 1767 - RNA, 25 nt, Artificial Sequence
  synthetic polynucleotide
aaguuaauuuaaaguuguuugugca

SEQ ID NO: 1768 - RNA, 25 nt, Artificial Sequence
  synthetic polynucleotide
aguuaauuuaaaguuguuugugcca

SEQ ID NO: 1769 - RNA, 25 nt, Artificial Sequence
  synthetic polynucleotide
guuaauuuaaaguuguuugugccua

SEQ ID NO: 1770 - RNA, 25 nt, Artificial Sequence
  synthetic polynucleotide
uuugauauuucaauguuagccucaa

SEQ ID NO: 1771 - RNA, 25 nt, Artificial Sequence
  synthetic polynucleotide
auauuucaauguuagccucaauuua

SEQ ID NO: 1772 - RNA, 25 nt, Artificial Sequence
  synthetic polynucleotide
guuagccucaauuucugaacaccaa

SEQ ID NO: 1773 - RNA, 25 nt, Artificial Sequence
  synthetic polynucleotide
agccucaauuucugaacaccauaga

SEQ ID NO: 1774 - RNA, 25 nt, Artificial Sequence
  synthetic polynucleotide
gccucaauuucugaacaccauagga

SEQ ID NO: 1775 - RNA, 25 nt, Artificial Sequence
  synthetic polynucleotide
ccucaauuucugaacaccauaggua

SEQ ID NO: 1776 - RNA, 25 nt, Artificial Sequence
  synthetic polynucleotide
cucaauuucugaacaccauagguaa

SEQ ID NO: 1777 - RNA, 25 nt, Artificial Sequence
  synthetic polynucleotide
ucaauuucugaacaccauagguaga

SEQ ID NO: 1778 - RNA, 25 nt, Artificial Sequence
  synthetic polynucleotide
caauuucugaacaccauagguagaa

SEQ ID NO: 1779 - RNA, 25 nt, Artificial Sequence
  synthetic polynucleotide
aauuucugaacaccauagguagaaa

SEQ ID NO: 1780 - RNA, 25 nt, Artificial Sequence
  synthetic polynucleotide
auuucugaacaccauagguagaaua

SEQ ID NO: 1781 - RNA, 25 nt, Artificial Sequence
  synthetic polynucleotide
uuucugaacaccauagguagaauga

SEQ ID NO: 1782 - RNA, 25 nt, Artificial Sequence
  synthetic polynucleotide
cugaacaccauagguagaauguaaa

SEQ ID NO: 1783 - RNA, 25 nt, Artificial Sequence
  synthetic polynucleotide
ugaacaccauagguagaauguaaaa

SEQ ID NO: 1784 - RNA, 25 nt, Artificial Sequence
  synthetic polynucleotide
gaacaccauagguagaauguaaaga

SEQ ID NO: 1785 - RNA, 25 nt, Artificial Sequence
  synthetic polynucleotide
aacaccauagguagaauguaaagca

SEQ ID NO: 1786 - RNA, 25 nt, Artificial Sequence
  synthetic polynucleotide
acaccauagguagaauguaaagcua

SEQ ID NO: 1787 - RNA, 25 nt, Artificial Sequence
  synthetic polynucleotide
accauagguagaauguaaagcuuga

SEQ ID NO: 1788 - RNA, 25 nt, Artificial Sequence
  synthetic polynucleotide
ccauagguagaauguaaagcuugua

SEQ ID NO: 1789 - RNA, 25 nt, Artificial Sequence
  synthetic polynucleotide
cauagguagaauguaaagcuuguca

SEQ ID NO: 1790 - RNA, 25 nt, Artificial Sequence
  synthetic polynucleotide
auagguagaauguaaagcuugucua

SEQ ID NO: 1791 - RNA, 25 nt, Artificial Sequence
  synthetic polynucleotide
agguagaauguaaagcuugucugaa

SEQ ID NO: 1792 - RNA, 25 nt, Artificial Sequence
  synthetic polynucleotide
aauguaaagcuugucugaucguuca

SEQ ID NO: 1793 - RNA, 25 nt, Artificial Sequence
  synthetic polynucleotide
ugaucguucaaagcaugaaauggaa

SEQ ID NO: 1794 - RNA, 25 nt, Artificial Sequence
  synthetic polynucleotide
cguucaaagcaugaaauggauacua

SEQ ID NO: 1795 - RNA, 25 nt, Artificial Sequence
  synthetic polynucleotide
guucaaagcaugaaauggauacuua

SEQ ID NO: 1796 - RNA, 25 nt, Artificial Sequence
  synthetic polynucleotide
uucaaagcaugaaauggauacuuaa

SEQ ID NO: 1797 - RNA, 25 nt, Artificial Sequence
  synthetic polynucleotide
uauggaaauucugcucagauagaaa

SEQ ID NO: 1798 - RNA, 25 nt, Artificial Sequence
  synthetic polynucleotide
auggaaauucugcucagauagaaua

SEQ ID NO: 1799 - RNA, 25 nt, Artificial Sequence
  synthetic polynucleotide
gcucagauagaaugacaguccguca

SEQ ID NO: 1800 - RNA, 25 nt, Artificial Sequence
  synthetic polynucleotide
cucagauagaaugacaguccgucaa

SEQ ID NO: 1801 - RNA, 25 nt, Artificial Sequence
  synthetic polynucleotide
cagauagaaugacaguccgucaaaa

SEQ ID NO: 1802 - RNA, 25 nt, Artificial Sequence
  synthetic polynucleotide
agauagaaugacaguccgucaaaaa

SEQ ID NO: 1803 - RNA, 25 nt, Artificial Sequence
  synthetic polynucleotide
auagaaugacaguccgucaaaacaa

SEQ ID NO: 1804 - RNA, 25 nt, Artificial Sequence
  synthetic polynucleotide
agaaugacaguccgucaaaacagaa

SEQ ID NO: 1805 - RNA, 25 nt, Artificial Sequence
  synthetic polynucleotide
gaaugacaguccgucaaaacagaua

SEQ ID NO: 1806 - RNA, 25 nt, Artificial Sequence
  synthetic polynucleotide
aguguccuuggcaggcugauuucua

SEQ ID NO: 1807 - RNA, 25 nt, Artificial Sequence
  synthetic polynucleotide
guguccuuggcaggcugauuucuaa

SEQ ID NO: 1808 - RNA, 25 nt, Artificial Sequence
  synthetic polynucleotide
ccuuggcaggcugauuucuagguaa

SEQ ID NO: 1809 - RNA, 25 nt, Artificial Sequence
  synthetic polynucleotide
gcugauuucuagguaggaaauguga

SEQ ID NO: 1810 - RNA, 25 nt, Artificial Sequence
  synthetic polynucleotide
cugauuucuagguaggaaaugugga

SEQ ID NO: 1811 - RNA, 25 nt, Artificial Sequence
  synthetic polynucleotide
gauuucuagguaggaaaugugguaa

SEQ ID NO: 1812 - RNA, 25 nt, Artificial Sequence
  synthetic polynucleotide
auuucuagguaggaaaugugguaga

SEQ ID NO: 1813 - RNA, 25 nt, Artificial Sequence
  synthetic polynucleotide
ggaaaugugguagccucacuuuuaa

SEQ ID NO: 1814 - RNA, 25 nt, Artificial Sequence
  synthetic polynucleotide
augugguagccucacuuuuaaugaa

SEQ ID NO: 1815 - RNA, 25 nt, Artificial Sequence
  synthetic polynucleotide
ugguagccucacuuuuaaugaacaa

SEQ ID NO: 1816 - RNA, 25 nt, Artificial Sequence
  synthetic polynucleotide
gccucacuuuuaaugaacaaaugga

SEQ ID NO: 1817 - RNA, 25 nt, Artificial Sequence
  synthetic polynucleotide
ccucacuuuuaaugaacaaauggca

SEQ ID NO: 1818 - RNA, 25 nt, Artificial Sequence
  synthetic polynucleotide
uuauuaaaaacugagugacucuaua

SEQ ID NO: 1819 - RNA, 25 nt, Artificial Sequence
  synthetic polynucleotide
uauuaaaaacugagugacucuauaa

SEQ ID NO: 1820 - RNA, 25 nt, Artificial Sequence
  synthetic polynucleotide
auuaaaaacugagugacucuauaua

SEQ ID NO: 1821 - RNA, 25 nt, Artificial Sequence
  synthetic polynucleotide
aaaaacugagugacucuauauagca

SEQ ID NO: 1822 - RNA, 25 nt, Artificial Sequence
  synthetic polynucleotide
aaaacugagugacucuauauagcua

SEQ ID NO: 1823 - RNA, 25 nt, Artificial Sequence
  synthetic polynucleotide
aaacugagugacucuauauagcuga

SEQ ID NO: 1824 - RNA, 25 nt, Artificial Sequence
  synthetic polynucleotide
aacugagugacucuauauagcugaa

SEQ ID NO: 1825 - RNA, 25 nt, Artificial Sequence
  synthetic polynucleotide
acugagugacucuauauagcugaua

SEQ ID NO: 1826 - RNA, 25 nt, Artificial Sequence
  synthetic polynucleotide
acuguuuuucggacaguuuauuuga

SEQ ID NO: 1827 - RNA, 25 nt, Artificial Sequence
  synthetic polynucleotide
cuguuuuucggacaguuuauuugua

SEQ ID NO: 1828 - RNA, 25 nt, Artificial Sequence
  synthetic polynucleotide
ucggacaguuuauuuguugagagua

SEQ ID NO: 1829 - RNA, 25 nt, Artificial Sequence
  synthetic polynucleotide
ggacaguuuauuuguugagagugua

SEQ ID NO: 1830 - RNA, 25 nt, Artificial Sequence
  synthetic polynucleotide
caguuuauuuguugagagugugaca

SEQ ID NO: 1831 - RNA, 25 nt, Artificial Sequence
  synthetic polynucleotide
aguuuauuuguugagagugugacca

SEQ ID NO: 1832 - RNA, 25 nt, Artificial Sequence
  synthetic polynucleotide
uuauuuguugagagugugaccaaaa

SEQ ID NO: 1833 - RNA, 25 nt, Artificial Sequence
  synthetic polynucleotide
uauuuguugagagugugaccaaaaa

SEQ ID NO: 1834 - RNA, 25 nt, Artificial Sequence
  synthetic polynucleotide
auuuguugagagugugaccaaaaga

SEQ ID NO: 1835 - RNA, 25 nt, Artificial Sequence
  synthetic polynucleotide
uuuguugagagugugaccaaaagua

SEQ ID NO: 1836 - RNA, 25 nt, Artificial Sequence
  synthetic polynucleotide
uuguugagagugugaccaaaaguua

SEQ ID NO: 1837 - RNA, 25 nt, Artificial Sequence
  synthetic polynucleotide
uguugagagugugaccaaaaguuaa

SEQ ID NO: 1838 - RNA, 25 nt, Artificial Sequence
  synthetic polynucleotide
guugagagugugaccaaaaguuaca

SEQ ID NO: 1839 - RNA, 25 nt, Artificial Sequence
  synthetic polynucleotide
uugagagugugaccaaaaguuacaa

SEQ ID NO: 1840 - RNA, 25 nt, Artificial Sequence
  synthetic polynucleotide
gagagugugaccaaaaguuacauga

SEQ ID NO: 1841 - RNA, 25 nt, Artificial Sequence
  synthetic polynucleotide
agagugugaccaaaaguuacaugua

SEQ ID NO: 1842 - RNA, 25 nt, Artificial Sequence
  synthetic polynucleotide
gagugugaccaaaaguuacauguua

SEQ ID NO: 1843 - RNA, 25 nt, Artificial Sequence
  synthetic polynucleotide
agugugaccaaaaguuacauguuua

SEQ ID NO: 1844 - RNA, 25 nt, Artificial Sequence
  synthetic polynucleotide
gugugaccaaaaguuacauguuuga

SEQ ID NO: 1845 - RNA, 25 nt, Artificial Sequence
  synthetic polynucleotide
ugugaccaaaaguuacauguuugca

SEQ ID NO: 1846 - RNA, 25 nt, Artificial Sequence
  synthetic polynucleotide
aaaaguuacauguuugcaccuuuca

SEQ ID NO: 1847 - RNA, 25 nt, Artificial Sequence
  synthetic polynucleotide
aaguuacauguuugcaccuuucuaa

SEQ ID NO: 1848 - RNA, 25 nt, Artificial Sequence
  synthetic polynucleotide
aguuacauguuugcaccuuucuaga

SEQ ID NO: 1849 - RNA, 25 nt, Artificial Sequence
  synthetic polynucleotide
uacauguuugcaccuuucuaguuga

SEQ ID NO: 1850 - RNA, 25 nt, Artificial Sequence
  synthetic polynucleotide
acauguuugcaccuuucuaguugaa

SEQ ID NO: 1851 - RNA, 25 nt, Artificial Sequence
  synthetic polynucleotide
cauguuugcaccuuucuaguugaaa

SEQ ID NO: 1852 - RNA, 25 nt, Artificial Sequence
  synthetic polynucleotide
uaccgagcuaaauucuguggaguau

SEQ ID NO: 1853 - RNA, 25 nt, Artificial Sequence
  synthetic polynucleotide
uaaugaacaaauggccuuuauuaaa

SEQ ID NO: 1854 - RNA, 25 nt, Artificial Sequence
  synthetic polynucleotide
uggacagcuuguggcaagugaauuu

SEQ ID NO: 1855 - RNA, 25 nt, Artificial Sequence
  synthetic polynucleotide
uguacuacaggaagauguacggaga

SEQ ID NO: 1856 - RNA, 25 nt, Artificial Sequence
  synthetic polynucleotide
gucaugaagaagaacaugauguuca

SEQ ID NO: 1857 - RNA, 25 nt, Artificial Sequence
  synthetic polynucleotide
ugaagaagaacaugauguucaucaa

SEQ ID NO: 1858 - RNA, 25 nt, Artificial Sequence
  synthetic polynucleotide
uuugaaucgcuguacuacaggaaga

SEQ ID NO: 1859 - RNA, 25 nt, Artificial Sequence
  synthetic polynucleotide
uucggacaguuuauuuguugagagu

SEQ ID NO: 1860 - RNA, 25 nt, Artificial Sequence
  synthetic polynucleotide
ucaugaagaagaacaugauguucau

SEQ ID NO: 1861 - RNA, 25 nt, Artificial Sequence
  synthetic polynucleotide
uuaaugaacaaauggccuuuauuaa

SEQ ID NO: 1862 - RNA, 25 nt, Artificial Sequence
  synthetic polynucleotide
ccaugucaaacaaauagucuaucaa

SEQ ID NO: 1863 - RNA, 25 nt, Artificial Sequence
  synthetic polynucleotide
acugucccggagacaaugacaucuu

SEQ ID NO: 1864 - RNA, 25 nt, Artificial Sequence
  synthetic polynucleotide
auuagacuggacagcuuguggcaag

SEQ ID NO: 1865 - RNA, 25 nt, Artificial Sequence
  synthetic polynucleotide
acuggacagcuuguggcaagugaau

SEQ ID NO: 1866 - RNA, 25 nt, Artificial Sequence
  synthetic polynucleotide
uauauauguacaguuaucuaaguua

SEQ ID NO: 1867 - RNA, 25 nt, Artificial Sequence
  synthetic polynucleotide
guuuauuuguugagagugugaccaa

SEQ ID NO: 1868 - RNA, 25 nt, Artificial Sequence
  synthetic polynucleotide
caagaucggcgugugcaccgccaaa

SEQ ID NO: 1869 - RNA, 25 nt, Artificial Sequence
  synthetic polynucleotide
gcugaccuggaagagaacauuaaga

SEQ ID NO: 1870 - RNA, 25 nt, Artificial Sequence
  synthetic polynucleotide
ucccggagacaaugacaucuuugaa

SEQ ID NO: 1871 - RNA, 25 nt, Artificial Sequence
  synthetic polynucleotide
guuuuucggacaguuuauuuguuga

SEQ ID NO: 1872 - RNA, 25 nt, Artificial Sequence
  synthetic polynucleotide
ccggagacaaugacaucuuugaauc

SEQ ID NO: 1873 - RNA, 25 nt, Artificial Sequence
  synthetic polynucleotide
cgcagcggagaguccuuccagagca

SEQ ID NO: 1874 - RNA, 25 nt, Artificial Sequence
  synthetic polynucleotide
agcaccagaauguauauuaaggugu

SEQ ID NO: 1875 - RNA, 25 nt, Artificial Sequence
  synthetic polynucleotide
ugauuagagccaacugccuggucca

SEQ ID NO: 1876 - RNA, 25 nt, Artificial Sequence
  synthetic polynucleotide
gucccggagacaaugacaucuuuga

SEQ ID NO: 1877 - RNA, 25 nt, Artificial Sequence
  synthetic polynucleotide
cuuuuaaugaacaaauggccuuuau

SEQ ID NO: 1878 - RNA, 25 nt, Artificial Sequence
  synthetic polynucleotide
augaagaagaacaugauguucauca

SEQ ID NO: 1879 - RNA, 25 nt, Artificial Sequence
  synthetic polynucleotide
guacggagacauggcaugaagccag

SEQ ID NO: 1880 - RNA, 25 nt, Artificial Sequence
  synthetic polynucleotide
cagcaccagaauguauauuaaggug

SEQ ID NO: 1881 - RNA, 25 nt, Artificial Sequence
  synthetic polynucleotide
ccaaccgcaagaucggcgugugcac

SEQ ID NO: 1882 - RNA, 25 nt, Artificial Sequence
  synthetic polynucleotide
cugccugguccagaccacagagugg

SEQ ID NO: 1883 - RNA, 25 nt, Artificial Sequence
  synthetic polynucleotide
accacagaguggagcgccuguucca

SEQ ID NO: 1884 - RNA, 25 nt, Artificial Sequence
  synthetic polynucleotide
gaaucgcuguacuacaggaagaugu

SEQ ID NO: 1885 - RNA, 25 nt, Artificial Sequence
  synthetic polynucleotide
aagaagaacaugauguucaucaaga

SEQ ID NO: 1886 - RNA, 25 nt, Artificial Sequence
  synthetic polynucleotide
gauguucaucaagaccugugccugc

SEQ ID NO: 1887 - RNA, 25 nt, Artificial Sequence
  synthetic polynucleotide
acagcaccagaauguauauuaaggu

SEQ ID NO: 1888 - RNA, 25 nt, Artificial Sequence
  synthetic polynucleotide
auauauauguacaguuaucuaaguu

SEQ ID NO: 1889 - RNA, 25 nt, Artificial Sequence
  synthetic polynucleotide
ggccaaccgcaagaucggcgugugc

SEQ ID NO: 1890 - RNA, 25 nt, Artificial Sequence
  synthetic polynucleotide
gcagcggagaguccuuccagagcag

SEQ ID NO: 1891 - RNA, 25 nt, Artificial Sequence
  synthetic polynucleotide
acaacgccuccugcaggcuagagaa

SEQ ID NO: 1892 - RNA, 25 nt, Artificial Sequence
  synthetic polynucleotide
agauguacggagacauggcaugaag

SEQ ID NO: 1893 - RNA, 25 nt, Artificial Sequence
  synthetic polynucleotide
uguacggagacauggcaugaagcca

SEQ ID NO: 1894 - RNA, 25 nt, Artificial Sequence
  synthetic polynucleotide
gacaguuuauuuguugagaguguga

SEQ ID NO: 1895 - RNA, 25 nt, Artificial Sequence
  synthetic polynucleotide
aaguuugagcuuucuggcugcacca

SEQ ID NO: 1896 - RNA, 25 nt, Artificial Sequence
  synthetic polynucleotide
cuuucuggcugcaccagcaugaaga

SEQ ID NO: 1897 - RNA, 25 nt, Artificial Sequence
  synthetic polynucleotide
ucaucaagaccugugccugccauua

SEQ ID NO: 1898 - RNA, 25 nt, Artificial Sequence
  synthetic polynucleotide
caugucaaacaaauagucuaucaac

SEQ ID NO: 1899 - RNA, 25 nt, Artificial Sequence
  synthetic polynucleotide
gacuggacagcuuguggcaagugaa

SEQ ID NO: 1900 - RNA, 25 nt, Artificial Sequence
  synthetic polynucleotide
cucacuuuuaaugaacaaauggccu

SEQ ID NO: 1901 - RNA, 25 nt, Artificial Sequence
  synthetic polynucleotide
gcugccgcgucugcgccaagcagcu

SEQ ID NO: 1902 - RNA, 25 nt, Artificial Sequence
  synthetic polynucleotide
guacuacaggaagauguacggagac

SEQ ID NO: 1903 - RNA, 25 nt, Artificial Sequence
  synthetic polynucleotide
agacuggacagcuuguggcaaguga

SEQ ID NO: 1904 - RNA, 25 nt, Artificial Sequence
  synthetic polynucleotide
cacuuuuaaugaacaaauggccuuu

SEQ ID NO: 1905 - RNA, 25 nt, Artificial Sequence
  synthetic polynucleotide
cggcgugugcaccgccaaagauggu

SEQ ID NO: 1906 - RNA, 25 nt, Artificial Sequence
  synthetic polynucleotide
gaagaagaacaugauguucaucaag

SEQ ID NO: 1907 - RNA, 25 nt, Artificial Sequence
  synthetic polynucleotide
agaacaugauguucaucaagaccug

SEQ ID NO: 1908 - RNA, 25 nt, Artificial Sequence
  synthetic polynucleotide
ggaagauguacggagacauggcaug

SEQ ID NO: 1909 - RNA, 25 nt, Artificial Sequence
  synthetic polynucleotide
cggagacaaugacaucuuugaaucg

SEQ ID NO: 1910 - RNA, 25 nt, Artificial Sequence
  synthetic polynucleotide
aggaagauguacggagacauggcau

SEQ ID NO: 1911 - RNA, 25 nt, Artificial Sequence
  synthetic polynucleotide
cgauuagacuggacagcuuguggca

SEQ ID NO: 1912 - RNA, 25 nt, Artificial Sequence
  synthetic polynucleotide
uuagacuggacagcuuguggcaagu

SEQ ID NO: 1913 - RNA, 25 nt, Artificial Sequence
  synthetic polynucleotide
accaaaaguuacauguuugcaccuu

SEQ ID NO: 1914 - RNA, 25 nt, Artificial Sequence
  synthetic polynucleotide
gagcuuucuggcugcaccagcauga

SEQ ID NO: 1915 - RNA, 25 nt, Artificial Sequence
  synthetic polynucleotide
ugucccggagacaaugacaucuuug

SEQ ID NO: 1916 - RNA, 25 nt, Artificial Sequence
  synthetic polynucleotide
uugaaucgcuguacuacaggaagau

SEQ ID NO: 1917 - RNA, 25 nt, Artificial Sequence
  synthetic polynucleotide
acuuuuaaugaacaaauggccuuua

SEQ ID NO: 1918 - RNA, 25 nt, Artificial Sequence
  synthetic polynucleotide
aucggcgugugcaccgccaaagaug

SEQ ID NO: 1919 - RNA, 25 nt, Artificial Sequence
  synthetic polynucleotide
aguggagcgccuguuccaagaccug

SEQ ID NO: 1920 - RNA, 25 nt, Artificial Sequence
  synthetic polynucleotide
uucuggcugcaccagcaugaagaca

SEQ ID NO: 1921 - RNA, 25 nt, Artificial Sequence
  synthetic polynucleotide
acacagcaccagaauguauauuaag

SEQ ID NO: 1922 - RNA, 25 nt, Artificial Sequence
  synthetic polynucleotide
ccugucgauuagacuggacagcuug

SEQ ID NO: 1923 - RNA, 25 nt, Artificial Sequence
  synthetic polynucleotide
gaucggcgugugcaccgccaaagau

SEQ ID NO: 1924 - RNA, 25 nt, Artificial Sequence
  synthetic polynucleotide
uaucaaguuugagcuuucuggcugc

SEQ ID NO: 1925 - RNA, 25 nt, Artificial Sequence
  synthetic polynucleotide
auguacggagacauggcaugaagcc

SEQ ID NO: 1926 - RNA, 25 nt, Artificial Sequence
  synthetic polynucleotide
gauuagacuggacagcuuguggcaa

SEQ ID NO: 1927 - RNA, 25 nt, Artificial Sequence
  synthetic polynucleotide
uauauauauguacaguuaucuaagu

SEQ ID NO: 1928 - RNA, 25 nt, Artificial Sequence
  synthetic polynucleotide
aaaguuacauguuugcaccuuucua

SEQ ID NO: 1929 - RNA, 25 nt, Artificial Sequence
  synthetic polynucleotide
cacagaguggagcgccuguuccaag

SEQ ID NO: 1930 - RNA, 25 nt, Artificial Sequence
  synthetic polynucleotide
caacgccuccugcaggcuagagaag

SEQ ID NO: 1931 - RNA, 25 nt, Artificial Sequence
  synthetic polynucleotide
uuuucggacaguuuauuuguugaga

SEQ ID NO: 1932 - RNA, 25 nt, Artificial Sequence
  synthetic polynucleotide
ccuccugcaggcuagagaagcagag

SEQ ID NO: 1933 - RNA, 25 nt, Artificial Sequence
  synthetic polynucleotide
gcuguacuacaggaagauguacgga

SEQ ID NO: 1934 - RNA, 25 nt, Artificial Sequence
  synthetic polynucleotide
cacagcaccagaauguauauuaagg

SEQ ID NO: 1935 - RNA, 25 nt, Artificial Sequence
  synthetic polynucleotide
cagcuuguggcaagugaauuugccu

SEQ ID NO: 1936 - RNA, 25 nt, Artificial Sequence
  synthetic polynucleotide
ugccugguccagaccacagagugga

SEQ ID NO: 1937 - RNA, 25 nt, Artificial Sequence
  synthetic polynucleotide
accacccugccgguggaguucaagu

SEQ ID NO: 1938 - RNA, 25 nt, Artificial Sequence
  synthetic polynucleotide
aagaacaugauguucaucaagaccu

SEQ ID NO: 1939 - RNA, 25 nt, Artificial Sequence
  synthetic polynucleotide
caucaagaccugugccugccauuac

SEQ ID NO: 1940 - RNA, 25 nt, Artificial Sequence
  synthetic polynucleotide
gauguacggagacauggcaugaagc

SEQ ID NO: 1941 - RNA, 25 nt, Artificial Sequence
  synthetic polynucleotide
cuggacagcuuguggcaagugaauu

SEQ ID NO: 1942 - RNA, 25 nt, Artificial Sequence
  synthetic polynucleotide
auauauauauguacaguuaucuaag

SEQ ID NO: 1943 - RNA, 25 nt, Artificial Sequence
  synthetic polynucleotide
gaccaaaaguuacauguuugcaccu

SEQ ID NO: 1944 - RNA, 25 nt, Artificial Sequence
  synthetic polynucleotide
gcggcugcugccgcgucugcgccaa

SEQ ID NO: 1945 - RNA, 25 nt, Artificial Sequence
  synthetic polynucleotide
gagccaacugccugguccagaccac

SEQ ID NO: 1946 - RNA, 25 nt, Artificial Sequence
  synthetic polynucleotide
ccaacugccugguccagaccacaga

SEQ ID NO: 1947 - RNA, 25 nt, Artificial Sequence
  synthetic polynucleotide
guucaucaagaccugugccugccau

SEQ ID NO: 1948 - RNA, 13 nt, Artificial Sequence
  synthetic polynucleotide
cucaugaauuaga

SEQ ID NO: 1949 - RNA, 19 nt, Artificial Sequence
  synthetic polynucleotide
ucuaauucaugagaaauac

SEQ ID NO: 1950 - RNA, 13 nt, Artificial Sequence
  synthetic polynucleotide
cugaggucaauua

SEQ ID NO: 1951 - RNA, 19 nt, Artificial Sequence
  synthetic polynucleotide
uaauugaccucagaagaug

SEQ ID NO: 1952 - RNA, 13 nt, Artificial Sequence
  synthetic polynucleotide
gaggucaauuaaa

SEQ ID NO: 1953 - RNA, 19 nt, Artificial Sequence
  synthetic polynucleotide
uuuaauugaccucagaaga

SEQ ID NO: 1954 - RNA, 13 nt, Artificial Sequence
  synthetic polynucleotide
ucugaggucaauu

SEQ ID NO: 1955 - RNA, 19 nt, Artificial Sequence
  synthetic polynucleotide
aauugaccucagaagaugc

SEQ ID NO: 1956 - RNA, 13 nt, Artificial Sequence
  synthetic polynucleotide
ugaggucaauuaa

SEQ ID NO: 1957 - RNA, 19 nt, Artificial Sequence
  synthetic polynucleotide
uuaauugaccucagaagau

SEQ ID NO: 1958 - RNA, 13 nt, Artificial Sequence
  synthetic polynucleotide
uucugaggucaau

SEQ ID NO: 1959 - RNA, 19 nt, Artificial Sequence
  synthetic polynucleotide
auugaccucagaagaugca

SEQ ID NO: 1960 - RNA, 13 nt, Artificial Sequence
  synthetic polynucleotide
gucagcuggauga

SEQ ID NO: 1961 - RNA, 19 nt, Artificial Sequence
  synthetic polynucleotide
ucauccagcugacucguuu

SEQ ID NO: 1962 - RNA, 13 nt, Artificial Sequence
  synthetic polynucleotide
uucugaugaaucu

SEQ ID NO: 1963 - RNA, 19 nt, Artificial Sequence
  synthetic polynucleotide
agauucaucagaaugguga

SEQ ID NO: 1964 - RNA, 13 nt, Artificial Sequence
  synthetic polynucleotide
uggacugagguca

SEQ ID NO: 1965 - RNA, 19 nt, Artificial Sequence
  synthetic polynucleotide
ugaccucaguccauaaacc

SEQ ID NO: 1966 - RNA, 13 nt, Artificial Sequence
  synthetic polynucleotide
gagucucaccauu

SEQ ID NO: 1967 - RNA, 19 nt, Artificial Sequence
  synthetic polynucleotide
aauggugagacucaucaga

SEQ ID NO: 1968 - RNA, 13 nt, Artificial Sequence
  synthetic polynucleotide
gacugaggucaaa

SEQ ID NO: 1969 - RNA, 19 nt, Artificial Sequence
  synthetic polynucleotide
uuugaccucaguccauaaa

SEQ ID NO: 1970 - RNA, 13 nt, Artificial Sequence
  synthetic polynucleotide
ucacagccaugaa

SEQ ID NO: 1971 - RNA, 19 nt, Artificial Sequence
  synthetic polynucleotide
uucauggcugugaaauuca

SEQ ID NO: 1972 - RNA, 13 nt, Artificial Sequence
  synthetic polynucleotide
agucucaccauuc

SEQ ID NO: 1973 - RNA, 19 nt, Artificial Sequence
  synthetic polynucleotide
gaauggugagacucaucag

SEQ ID NO: 1974 - RNA, 13 nt, Artificial Sequence
  synthetic polynucleotide
aagcggaaagcca

SEQ ID NO: 1975 - RNA, 19 nt, Artificial Sequence
  synthetic polynucleotide
uggcuuuccgcuuauauaa

SEQ ID NO: 1976 - RNA, 13 nt, Artificial Sequence
  synthetic polynucleotide
agcggaaagccaa

SEQ ID NO: 1977 - RNA, 19 nt, Artificial Sequence
  synthetic polynucleotide
uuggcuuuccgcuuauaua

SEQ ID NO: 1978 - RNA, 13 nt, Artificial Sequence
  synthetic polynucleotide
accacauggauga

SEQ ID NO: 1979 - RNA, 19 nt, Artificial Sequence
  synthetic polynucleotide
ucauccauguggucauggc

SEQ ID NO: 1980 - RNA, 13 nt, Artificial Sequence
  synthetic polynucleotide
gccaugaccacau

SEQ ID NO: 1981 - RNA, 19 nt, Artificial Sequence
  synthetic polynucleotide
auguggucauggcuuucgu

SEQ ID NO: 1982 - RNA, 13 nt, Artificial Sequence
  synthetic polynucleotide
aagccaugaccac

SEQ ID NO: 1983 - RNA, 19 nt, Artificial Sequence
  synthetic polynucleotide
guggucauggcuuucguug

SEQ ID NO: 1984 - RNA, 13 nt, Artificial Sequence
  synthetic polynucleotide
gcggaaagccaau

SEQ ID NO: 1985 - RNA, 19 nt, Artificial Sequence
  synthetic polynucleotide
auuggcuuuccgcuuauau

SEQ ID NO: 1986 - RNA, 13 nt, Artificial Sequence
  synthetic polynucleotide
aaauuucguauuu

SEQ ID NO: 1987 - RNA, 19 nt, Artificial Sequence
  synthetic polynucleotide
aaauacgaaauuucaggug

SEQ ID NO: 1988 - RNA, 13 nt, Artificial Sequence
  synthetic polynucleotide
auuucguauuucu

SEQ ID NO: 1989 - RNA, 19 nt, Artificial Sequence
  synthetic polynucleotide
agaaauacgaaauuucagg

SEQ ID NO: 1990 - RNA, 13 nt, Artificial Sequence
  synthetic polynucleotide
aaagccaugacca

SEQ ID NO: 1991 - RNA, 19 nt, Artificial Sequence
  synthetic polynucleotide
uggucauggcuuucguugg

SEQ ID NO: 1992 - RNA, 13 nt, Artificial Sequence
  synthetic polynucleotide
acauggaugauau

SEQ ID NO: 1993 - RNA, 19 nt, Artificial Sequence
  synthetic polynucleotide
auaucauccauguggucau

SEQ ID NO: 1994 - RNA, 13 nt, Artificial Sequence
  synthetic polynucleotide
gaaauuucguauu

SEQ ID NO: 1995 - RNA, 19 nt, Artificial Sequence
  synthetic polynucleotide
aauacgaaauuucaggugu

SEQ ID NO: 1996 - RNA, 13 nt, Artificial Sequence
  synthetic polynucleotide
gcgccuucugauu

SEQ ID NO: 1997 - RNA, 19 nt, Artificial Sequence
  synthetic polynucleotide
aaucagaaggcgcguucag

SEQ ID NO: 1998 - RNA, 13 nt, Artificial Sequence
  synthetic polynucleotide
auuucucaugaau

SEQ ID NO: 1999 - RNA, 19 nt, Artificial Sequence
  synthetic polynucleotide
auucaugagaaauacgaaa

SEQ ID NO: 2000 - RNA, 13 nt, Artificial Sequence
  synthetic polynucleotide
cucucaugaauag

SEQ ID NO: 2001 - RNA, 19 nt, Artificial Sequence
  synthetic polynucleotide
cuauucaugagagaauaac

SEQ ID NO: 2002 - RNA, 13 nt, Artificial Sequence
  synthetic polynucleotide
aaguccaacgaaa

SEQ ID NO: 2003 - RNA, 19 nt, Artificial Sequence
  synthetic polynucleotide
uuucguuggacuuacuugg

SEQ ID NO: 2004 - RNA, 13 nt, Artificial Sequence
  synthetic polynucleotide
augaugagagcaa

SEQ ID NO: 2005 - RNA, 19 nt, Artificial Sequence
  synthetic polynucleotide
uugcucucaucauuggcuu

SEQ ID NO: 2006 - RNA, 13 nt, Artificial Sequence
  synthetic polynucleotide
gcgaggaguugaa

SEQ ID NO: 2007 - RNA, 19 nt, Artificial Sequence
  synthetic polynucleotide
uucaacuccucgcuuucca

SEQ ID NO: 2008 - RNA, 13 nt, Artificial Sequence
  synthetic polynucleotide
ugauugauaguca

SEQ ID NO: 2009 - RNA, 19 nt, Artificial Sequence
  synthetic polynucleotide
ugacuaucaaucacaucgg

SEQ ID NO: 2010 - RNA, 13 nt, Artificial Sequence
  synthetic polynucleotide
agauagugcaucu

SEQ ID NO: 2011 - RNA, 19 nt, Artificial Sequence
  synthetic polynucleotide
agaugcacuaucuaauuca

SEQ ID NO: 2012 - RNA, 13 nt, Artificial Sequence
  synthetic polynucleotide
auguguaucuauu

SEQ ID NO: 2013 - RNA, 19 nt, Artificial Sequence
  synthetic polynucleotide
aauagauacacauucaacc

SEQ ID NO: 2014 - RNA, 13 nt, Artificial Sequence
  synthetic polynucleotide
uucuauagaagaa

SEQ ID NO: 2015 - RNA, 19 nt, Artificial Sequence
  synthetic polynucleotide
uucuucuauagaaugaaca

SEQ ID NO: 2016 - RNA, 13 nt, Artificial Sequence
  synthetic polynucleotide
uuguccagcaauu

SEQ ID NO: 2017 - RNA, 19 nt, Artificial Sequence
  synthetic polynucleotide
aauugcuggacaaccgugg

SEQ ID NO: 2018 - RNA, 13 nt, Artificial Sequence
  synthetic polynucleotide
acauggaaagcga

SEQ ID NO: 2019 - RNA, 19 nt, Artificial Sequence
  synthetic polynucleotide
ucgcuuuccaugugugagg

SEQ ID NO: 2020 - RNA, 13 nt, Artificial Sequence
  synthetic polynucleotide
gcaguccagauua

SEQ ID NO: 2021 - RNA, 19 nt, Artificial Sequence
  synthetic polynucleotide
uaaucuggacugcuugugg

SEQ ID NO: 2022 - RNA, 13 nt, Artificial Sequence
  synthetic polynucleotide
ugguugaaugugu

SEQ ID NO: 2023 - RNA, 19 nt, Artificial Sequence
  synthetic polynucleotide
acacauucaaccaauaaac

SEQ ID NO: 2024 - RNA, 13 nt, Artificial Sequence
  synthetic polynucleotide
uuaugaaacgagu

SEQ ID NO: 2025 - RNA, 19 nt, Artificial Sequence
  synthetic polynucleotide
acucguuucauaacugucc

SEQ ID NO: 2026 - RNA, 13 nt, Artificial Sequence
  synthetic polynucleotide
caguccagauuau

SEQ ID NO: 2027 - RNA, 19 nt, Artificial Sequence
  synthetic polynucleotide
auaaucuggacugcuugug

SEQ ID NO: 2028 - RNA, 13 nt, Artificial Sequence
  synthetic polynucleotide
auauaagcggaaa

SEQ ID NO: 2029 - RNA, 19 nt, Artificial Sequence
  synthetic polynucleotide
uuuccgcuuauauaaucug

SEQ ID NO: 2030 - RNA, 13 nt, Artificial Sequence
  synthetic polynucleotide
uaccaguuaaaca

SEQ ID NO: 2031 - RNA, 19 nt, Artificial Sequence
  synthetic polynucleotide
uguuuaacugguauggcac

SEQ ID NO: 2032 - RNA, 13 nt, Artificial Sequence
  synthetic polynucleotide
uguucauucuaua

SEQ ID NO: 2033 - RNA, 19 nt, Artificial Sequence
  synthetic polynucleotide
uauagaaugaacauagaca

SEQ ID NO: 2034 - RNA, 13 nt, Artificial Sequence
  synthetic polynucleotide
ccgaccaaggaaa

SEQ ID NO: 2035 - RNA, 19 nt, Artificial Sequence
  synthetic polynucleotide
uuuccuuggucggcguuug

SEQ ID NO: 2036 - RNA, 13 nt, Artificial Sequence
  synthetic polynucleotide
gaauggugcauac

SEQ ID NO: 2037 - RNA, 19 nt, Artificial Sequence
  synthetic polynucleotide
guaugcaccauucaacucc

SEQ ID NO: 2038 - RNA, 13 nt, Artificial Sequence
  synthetic polynucleotide
auaugauggccga

SEQ ID NO: 2039 - RNA, 19 nt, Artificial Sequence
  synthetic polynucleotide
ucggccaucauaugugucu

SEQ ID NO: 2040 - RNA, 13 nt, Artificial Sequence
  synthetic polynucleotide
agcaguccagauu

SEQ ID NO: 2041 - RNA, 19 nt, Artificial Sequence
  synthetic polynucleotide
aaucuggacugcuuguggc

SEQ ID NO: 2042 - RNA, 13 nt, Artificial Sequence
  synthetic polynucleotide
gcauuuagucaaa

SEQ ID NO: 2043 - RNA, 19 nt, Artificial Sequence
  synthetic polynucleotide
uuugacuaaaugcaaagug

SEQ ID NO: 2044 - RNA, 13 nt, Artificial Sequence
  synthetic polynucleotide
agcauuccgaugu

SEQ ID NO: 2045 - RNA, 19 nt, Artificial Sequence
  synthetic polynucleotide
acaucggaaugcucauugc

SEQ ID NO: 2046 - RNA, 13 nt, Artificial Sequence
  synthetic polynucleotide
uagucaggaacuu

SEQ ID NO: 2047 - RNA, 19 nt, Artificial Sequence
  synthetic polynucleotide
aaguuccugacuaucaauc

SEQ ID NO: 2048 - RNA, 13 nt, Artificial Sequence
  synthetic polynucleotide
ugcauuuagucaa

SEQ ID NO: 2049 - RNA, 19 nt, Artificial Sequence
  synthetic polynucleotide
uugacuaaaugcaaaguga

SEQ ID NO: 2050 - RNA, 13 nt, Artificial Sequence
  synthetic polynucleotide
gucugaugagucu

SEQ ID NO: 2051 - RNA, 19 nt, Artificial Sequence
  synthetic polynucleotide
agacucaucagacugguga

SEQ ID NO: 2052 - RNA, 13 nt, Artificial Sequence
  synthetic polynucleotide
uagacacauauga

SEQ ID NO: 2053 - RNA, 19 nt, Artificial Sequence
  synthetic polynucleotide
ucauaugugucuacugugg

SEQ ID NO: 2054 - RNA, 13 nt, Artificial Sequence
  synthetic polynucleotide
cagacgaggacau

SEQ ID NO: 2055 - RNA, 19 nt, Artificial Sequence
  synthetic polynucleotide
auguccucgucuguagcau

SEQ ID NO: 2056 - RNA, 13 nt, Artificial Sequence
  synthetic polynucleotide
cagccgugaauuc

SEQ ID NO: 2057 - RNA, 19 nt, Artificial Sequence
  synthetic polynucleotide
gaauucacggcugacuuug

SEQ ID NO: 2058 - RNA, 13 nt, Artificial Sequence
  synthetic polynucleotide
agucuggaaauaa

SEQ ID NO: 2059 - RNA, 19 nt, Artificial Sequence
  synthetic polynucleotide
uuauuuccagacucaaaua

SEQ ID NO: 2060 - RNA, 13 nt, Artificial Sequence
  synthetic polynucleotide
aguuuguggcuuc

SEQ ID NO: 2061 - RNA, 19 nt, Artificial Sequence
  synthetic polynucleotide
gaagccacaaacuaaacua

SEQ ID NO: 2062 - RNA, 13 nt, Artificial Sequence
  synthetic polynucleotide
aguccaacgaaag

SEQ ID NO: 2063 - RNA, 19 nt, Artificial Sequence
  synthetic polynucleotide
cuuucguuggacuuacuug

SEQ ID NO: 2064 - RNA, 13 nt, Artificial Sequence
  synthetic polynucleotide
aaguuucgcagac

SEQ ID NO: 2065 - RNA, 19 nt, Artificial Sequence
  synthetic polynucleotide
gucugcgaaacuucuuaga

SEQ ID NO: 2066 - RNA, 13 nt, Artificial Sequence
  synthetic polynucleotide
agcaaugagcauu

SEQ ID NO: 2067 - RNA, 19 nt, Artificial Sequence
  synthetic polynucleotide
aaugcucauugcucucauc

SEQ ID NO: 2068 - RNA, 13 nt, Artificial Sequence
  synthetic polynucleotide
uuagauagugcau

SEQ ID NO: 2069 - RNA, 19 nt, Artificial Sequence
  synthetic polynucleotide
augcacuaucuaauucaug

SEQ ID NO: 2070 - RNA, 13 nt, Artificial Sequence
  synthetic polynucleotide
uggugcauacaag

SEQ ID NO: 2071 - RNA, 19 nt, Artificial Sequence
  synthetic polynucleotide
cuuguaugcaccauucaac

SEQ ID NO: 2072 - RNA, 13 nt, Artificial Sequence
  synthetic polynucleotide
augaaacgaguca

SEQ ID NO: 2073 - RNA, 19 nt, Artificial Sequence
  synthetic polynucleotide
ugacucguuucauaacugu

SEQ ID NO: 2074 - RNA, 13 nt, Artificial Sequence
  synthetic polynucleotide
ccagagugcugaa

SEQ ID NO: 2075 - RNA, 19 nt, Artificial Sequence
  synthetic polynucleotide
uucagcacucuggucaucc

SEQ ID NO: 2076 - RNA, 13 nt, Artificial Sequence
  synthetic polynucleotide
cagccaugaauuu

SEQ ID NO: 2077 - RNA, 19 nt, Artificial Sequence
  synthetic polynucleotide
aaauucauggcuguggaau

SEQ ID NO: 2078 - RNA, 13 nt, Artificial Sequence
  synthetic polynucleotide
auugguugaaugu

SEQ ID NO: 2079 - RNA, 19 nt, Artificial Sequence
  synthetic polynucleotide
acauucaaccaauaaacug

SEQ ID NO: 2080 - RNA, 13 nt, Artificial Sequence
  synthetic polynucleotide
gguugaaugugua

SEQ ID NO: 2081 - RNA, 19 nt, Artificial Sequence
  synthetic polynucleotide
uacacauucaaccaauaaa

SEQ ID NO: 2082 - RNA, 13 nt, Artificial Sequence
  synthetic polynucleotide
ggaaauaacuaau

SEQ ID NO: 2083 - RNA, 19 nt, Artificial Sequence
  synthetic polynucleotide
auuaguuauuuccagacuc

SEQ ID NO: 2084 - RNA, 13 nt, Artificial Sequence
  synthetic polynucleotide
ucaugaauagaaa

SEQ ID NO: 2085 - RNA, 19 nt, Artificial Sequence
  synthetic polynucleotide
uuucuauucaugagagaau

SEQ ID NO: 2086 - RNA, 13 nt, Artificial Sequence
  synthetic polynucleotide
gccagcaaccgaa

SEQ ID NO: 2087 - RNA, 19 nt, Artificial Sequence
  synthetic polynucleotide
uucgguugcuggcaggucc

SEQ ID NO: 2088 - RNA, 13 nt, Artificial Sequence
  synthetic polynucleotide
caccucacacaug

SEQ ID NO: 2089 - RNA, 19 nt, Artificial Sequence
  synthetic polynucleotide
caugugugaggugaugucc

SEQ ID NO: 2090 - RNA, 13 nt, Artificial Sequence
  synthetic polynucleotide
aguugaauggugc

SEQ ID NO: 2091 - RNA, 19 nt, Artificial Sequence
  synthetic polynucleotide
gcaccauucaacuccucgc

SEQ ID NO: 2092 - RNA, 13 nt, Artificial Sequence
  synthetic polynucleotide
agucagcuggaug

SEQ ID NO: 2093 - RNA, 19 nt, Artificial Sequence
  synthetic polynucleotide
cauccagcugacucguuuc

SEQ ID NO: 2094 - RNA, 13 nt, Artificial Sequence
  synthetic polynucleotide
uauaagcggaaag

SEQ ID NO: 2095 - RNA, 19 nt, Artificial Sequence
  synthetic polynucleotide
cuuuccgcuuauauaaucu

SEQ ID NO: 2096 - RNA, 13 nt, Artificial Sequence
  synthetic polynucleotide
uuccgaugugauu

SEQ ID NO: 2097 - RNA, 19 nt, Artificial Sequence
  synthetic polynucleotide
aaucacaucggaaugcuca

SEQ ID NO: 2098 - RNA, 13 nt, Artificial Sequence
  synthetic polynucleotide
auaacuaaugugu

SEQ ID NO: 2099 - RNA, 19 nt, Artificial Sequence
  synthetic polynucleotide
acacauuaguuauuuccag

SEQ ID NO: 2100 - RNA, 13 nt, Artificial Sequence
  synthetic polynucleotide
ucauucuauagaa

SEQ ID NO: 2101 - RNA, 19 nt, Artificial Sequence
  synthetic polynucleotide
uucuauagaaugaacauag

SEQ ID NO: 2102 - RNA, 13 nt, Artificial Sequence
  synthetic polynucleotide
aacuaucacugua

SEQ ID NO: 2103 - RNA, 19 nt, Artificial Sequence
  synthetic polynucleotide
uacagugauaguuugcauu

SEQ ID NO: 2104 - RNA, 13 nt, Artificial Sequence
  synthetic polynucleotide
gucaauugcuuau

SEQ ID NO: 2105 - RNA, 19 nt, Artificial Sequence
  synthetic polynucleotide
auaagcaauugacaccacc

SEQ ID NO: 2106 - RNA, 13 nt, Artificial Sequence
  synthetic polynucleotide
agcaauuaauaaa

SEQ ID NO: 2107 - RNA, 19 nt, Artificial Sequence
  synthetic polynucleotide
uuuauuaauugcuggacaa

SEQ ID NO: 2108 - RNA, 13 nt, Artificial Sequence
  synthetic polynucleotide
acgacucugauga

SEQ ID NO: 2109 - RNA, 19 nt, Artificial Sequence
  synthetic polynucleotide
ucaucagagucguucgagu

SEQ ID NO: 2110 - RNA, 13 nt, Artificial Sequence
  synthetic polynucleotide
uagugugguuuau

SEQ ID NO: 2111 - RNA, 19 nt, Artificial Sequence
  synthetic polynucleotide
auaaaccacacuaucaccu

SEQ ID NO: 2112 - RNA, 13 nt, Artificial Sequence
  synthetic polynucleotide
aagccaaugauga

SEQ ID NO: 2113 - RNA, 19 nt, Artificial Sequence
  synthetic polynucleotide
ucaucauuggcuuuccgcu

SEQ ID NO: 2114 - RNA, 13 nt, Artificial Sequence
  synthetic polynucleotide
auagucaggaacu

SEQ ID NO: 2115 - RNA, 19 nt, Artificial Sequence
  synthetic polynucleotide
aguuccugacuaucaauca

SEQ ID NO: 2116 - RNA, 13 nt, Artificial Sequence
  synthetic polynucleotide
agucagccgugaa

SEQ ID NO: 2117 - RNA, 19 nt, Artificial Sequence
  synthetic polynucleotide
uucacggcugacuuuggaa

SEQ ID NO: 2118 - RNA, 13 nt, Artificial Sequence
  synthetic polynucleotide
acuaccaugagaa

SEQ ID NO: 2119 - RNA, 19 nt, Artificial Sequence
  synthetic polynucleotide
uucucaugguagugaguuu

SEQ ID NO: 2120 - RNA, 13 nt, Artificial Sequence
  synthetic polynucleotide
aaacaggcugauu

SEQ ID NO: 2121 - RNA, 19 nt, Artificial Sequence
  synthetic polynucleotide
aaucagccuguuuaacugg

SEQ ID NO: 2122 - RNA, 13 nt, Artificial Sequence
  synthetic polynucleotide
gagugcugaaacc

SEQ ID NO: 2123 - RNA, 19 nt, Artificial Sequence
  synthetic polynucleotide
gguuucagcacucugguca

SEQ ID NO: 2124 - RNA, 13 nt, Artificial Sequence
  synthetic polynucleotide
ugagcauuccgau

SEQ ID NO: 2125 - RNA, 19 nt, Artificial Sequence
  synthetic polynucleotide
aucggaaugcucauugcuc

SEQ ID NO: 2126 - RNA, 13 nt, Artificial Sequence
  synthetic polynucleotide
aauuccacagcca

SEQ ID NO: 2127 - RNA, 19 nt, Artificial Sequence
  synthetic polynucleotide
uggcuguggaauucacggc

SEQ ID NO: 2128 - RNA, 13 nt, Artificial Sequence
  synthetic polynucleotide
ugucaauugcuua

SEQ ID NO: 2129 - RNA, 19 nt, Artificial Sequence
  synthetic polynucleotide
uaagcaauugacaccacca

SEQ ID NO: 2130 - RNA, 13 nt, Artificial Sequence
  synthetic polynucleotide
accaugagaauug

SEQ ID NO: 2131 - RNA, 19 nt, Artificial Sequence
  synthetic polynucleotide
caauucucaugguagugag

SEQ ID NO: 2132 - RNA, 13 nt, Artificial Sequence
  synthetic polynucleotide
ccaacgaaagcca

SEQ ID NO: 2133 - RNA, 19 nt, Artificial Sequence
  synthetic polynucleotide
uggcuuucguuggacuuac

SEQ ID NO: 2134 - RNA, 13 nt, Artificial Sequence
  synthetic polynucleotide
cuggucacugauu

SEQ ID NO: 2135 - RNA, 19 nt, Artificial Sequence
  synthetic polynucleotide
aaucagugaccaguucauc

SEQ ID NO: 2136 - RNA, 13 nt, Artificial Sequence
  synthetic polynucleotide
ugguuuauggacu

SEQ ID NO: 2137 - RNA, 19 nt, Artificial Sequence
  synthetic polynucleotide
aguccauaaaccacacuau

SEQ ID NO: 2138 - RNA, 13 nt, Artificial Sequence
  synthetic polynucleotide
gaccagagugcug

SEQ ID NO: 2139 - RNA, 19 nt, Artificial Sequence
  synthetic polynucleotide
cagcacucuggucauccag

SEQ ID NO: 2140 - RNA, 13 nt, Artificial Sequence
  synthetic polynucleotide
gaugugauugaua

SEQ ID NO: 2141 - RNA, 19 nt, Artificial Sequence
  synthetic polynucleotide
uaucaaucacaucggaaug

SEQ ID NO: 2142 - RNA, 13 nt, Artificial Sequence
  synthetic polynucleotide
gucagccgugaau

SEQ ID NO: 2143 - RNA, 19 nt, Artificial Sequence
  synthetic polynucleotide
auucacggcugacuuugga

SEQ ID NO: 2144 - RNA, 13 nt, Artificial Sequence
  synthetic polynucleotide
aauguguaucuau

SEQ ID NO: 2145 - RNA, 19 nt, Artificial Sequence
  synthetic polynucleotide
auagauacacauucaacca

SEQ ID NO: 2146 - RNA, 13 nt, Artificial Sequence
  synthetic polynucleotide
uugagucuggaaa

SEQ ID NO: 2147 - RNA, 19 nt, Artificial Sequence
  synthetic polynucleotide
uuuccagacucaaauagau

SEQ ID NO: 2148 - RNA, 13 nt, Artificial Sequence
  synthetic polynucleotide
guccagcaauuaa

SEQ ID NO: 2149 - RNA, 19 nt, Artificial Sequence
  synthetic polynucleotide
uuaauugcuggacaaccgu

SEQ ID NO: 2150 - RNA, 13 nt, Artificial Sequence
  synthetic polynucleotide
ccagcaauuaaua

SEQ ID NO: 2151 - RNA, 19 nt, Artificial Sequence
  synthetic polynucleotide
uauuaauugcuggacaacc

SEQ ID NO: 2152 - RNA, 13 nt, Artificial Sequence
  synthetic polynucleotide
gacucgaacgacu

SEQ ID NO: 2153 - RNA, 19 nt, Artificial Sequence
  synthetic polynucleotide
agucguucgagucaaugga

SEQ ID NO: 2154 - RNA, 13 nt, Artificial Sequence
  synthetic polynucleotide
accugccagcaac

SEQ ID NO: 2155 - RNA, 19 nt, Artificial Sequence
  synthetic polynucleotide
guugcuggcagguccgugg

SEQ ID NO: 2156 - RNA, 13 nt, Artificial Sequence
  synthetic polynucleotide
gaugaaucugaua

SEQ ID NO: 2157 - RNA, 19 nt, Artificial Sequence
  synthetic polynucleotide
uaucagauucaucagaaug

SEQ ID NO: 2158 - RNA, 14 nt, Artificial Sequence
  synthetic polynucleotide
ugaugaaucugaua

SEQ ID NO: 2159 - RNA, 19 nt, Artificial Sequence
  synthetic polynucleotide
uaucagauucaucagaaug

SEQ ID NO: 2160 - RNA, 13 nt, Artificial Sequence
  synthetic polynucleotide
auuugcuuuugca

SEQ ID NO: 2161 - RNA, 19 nt, Artificial Sequence
  synthetic polynucleotide
ugcaaaagcaaaucacugc

SEQ ID NO: 2162 - RNA, 14 nt, Artificial Sequence
  synthetic polynucleotide
gauuugcuuuugca

SEQ ID NO: 2163 - RNA, 19 nt, Artificial Sequence
  synthetic polynucleotide
ugcaaaagcaaaucacugc

SEQ ID NO: 2164 - RNA, 13 nt, Artificial Sequence
  synthetic polynucleotide
gugauuugcuuua

SEQ ID NO: 2165 - RNA, 19 nt, Artificial Sequence
  synthetic polynucleotide
uaaagcaaaucacugcaau

SEQ ID NO: 2166 - RNA, 14 nt, Artificial Sequence
  synthetic polynucleotide
agugauuugcuuua

SEQ ID NO: 2167 - RNA, 19 nt, Artificial Sequence
  synthetic polynucleotide
uaaagcaaaucacugcaau

SEQ ID NO: 2168 - RNA, 13 nt, Artificial Sequence
  synthetic polynucleotide
aauuucguauuua

SEQ ID NO: 2169 - RNA, 19 nt, Artificial Sequence
  synthetic polynucleotide
uaaauacgaaauuucaggu

SEQ ID NO: 2170 - RNA, 14 nt, Artificial Sequence
  synthetic polynucleotide
aaauuucguauuua

SEQ ID NO: 2171 - RNA, 19 nt, Artificial Sequence
  synthetic polynucleotide
uaaauacgaaauuucaggu

SEQ ID NO: 2172 - RNA, 13 nt, Artificial Sequence
  synthetic polynucleotide
cacagccaugaaa

SEQ ID NO: 2173 - RNA, 19 nt, Artificial Sequence
  synthetic polynucleotide
uuucauggcugugaaauuc

SEQ ID NO: 2174 - RNA, 14 nt, Artificial Sequence
  synthetic polynucleotide
ucacagccaugaaa

SEQ ID NO: 2175 - RNA, 19 nt, Artificial Sequence
  synthetic polynucleotide
uuucauggcugugaaauuc

SEQ ID NO: 2176 - RNA, 13 nt, Artificial Sequence
  synthetic polynucleotide
gauuugcuuuuga

SEQ ID NO: 2177 - RNA, 19 nt, Artificial Sequence
  synthetic polynucleotide
ucaaaagcaaaucacugca

SEQ ID NO: 2178 - RNA, 14 nt, Artificial Sequence
  synthetic polynucleotide
ugauuugcuuuuga

SEQ ID NO: 2179 - RNA, 19 nt, Artificial Sequence
  synthetic polynucleotide
ucaaaagcaaaucacugca

SEQ ID NO: 2180 - RNA, 13 nt, Artificial Sequence
  synthetic polynucleotide
uugcuuuugccua

SEQ ID NO: 2181 - RNA, 19 nt, Artificial Sequence
  synthetic polynucleotide
uaggcaaaagcaaaucacu

SEQ ID NO: 2182 - RNA, 14 nt, Artificial Sequence
  synthetic polynucleotide
uuugcuuuugccua

SEQ ID NO: 2183 - RNA, 19 nt, Artificial Sequence
  synthetic polynucleotide
uaggcaaaagcaaaucacu

SEQ ID NO: 2184 - RNA, 13 nt, Artificial Sequence
  synthetic polynucleotide
uuucucaguuuaa

SEQ ID NO: 2185 - RNA, 19 nt, Artificial Sequence
  synthetic polynucleotide
uuaaacugagaaagaagca

SEQ ID NO: 2186 - RNA, 13 nt, Artificial Sequence
  synthetic polynucleotide
uugcauuuaguca

SEQ ID NO: 2187 - RNA, 19 nt, Artificial Sequence
  synthetic polynucleotide
ugacuaaaugcaaagugag

SEQ ID NO: 2188 - RNA, 13 nt, Artificial Sequence
  synthetic polynucleotide
acuuugcauuuaa

SEQ ID NO: 2189 - RNA, 19 nt, Artificial Sequence
  synthetic polynucleotide
uuaaaugcaaagugagaaa

SEQ ID NO: 2190 - RNA, 13 nt, Artificial Sequence
  synthetic polynucleotide
auuuagucaaaaa

SEQ ID NO: 2191 - RNA, 19 nt, Artificial Sequence
  synthetic polynucleotide
uuuuugacuaaaugcaaag

SEQ ID NO: 2192 - RNA, 13 nt, Artificial Sequence
  synthetic polynucleotide
uucuuucucagua

SEQ ID NO: 2193 - RNA, 19 nt, Artificial Sequence
  synthetic polynucleotide
uacugagaaagaagcauuu

SEQ ID NO: 2194 - RNA, 13 nt, Artificial Sequence
  synthetic polynucleotide
ucuuucucaguua

SEQ ID NO: 2195 - RNA, 19 nt, Artificial Sequence
  synthetic polynucleotide
uaacugagaaagaagcauu

SEQ ID NO: 2196 - RNA, 13 nt, Artificial Sequence
  synthetic polynucleotide
gaaagagaacaua

SEQ ID NO: 2197 - RNA, 19 nt, Artificial Sequence
  synthetic polynucleotide
uauguucucuuucauuuug

SEQ ID NO: 2198 - RNA, 13 nt, Artificial Sequence
  synthetic polynucleotide
cuuugcauuuaga

SEQ ID NO: 2199 - RNA, 19 nt, Artificial Sequence
  synthetic polynucleotide
ucuaaaugcaaagugagaa

SEQ ID NO: 2200 - RNA, 13 nt, Artificial Sequence
  synthetic polynucleotide
uuugcauuuagua

SEQ ID NO: 2201 - RNA, 19 nt, Artificial Sequence
  synthetic polynucleotide
uacuaaaugcaaagugaga

SEQ ID NO: 2202 - RNA, 13 nt, Artificial Sequence
  synthetic polynucleotide
cucacuuugcaua

SEQ ID NO: 2203 - RNA, 19 nt, Artificial Sequence
  synthetic polynucleotide
uaugcaaagugagaaauug

SEQ ID NO: 2204 - RNA, 13 nt, Artificial Sequence
  synthetic polynucleotide
uucucacuuugca

SEQ ID NO: 2205 - RNA, 19 nt, Artificial Sequence
  synthetic polynucleotide
ugcaaagugagaaauugua

SEQ ID NO: 2206 - RNA, 13 nt, Artificial Sequence
  synthetic polynucleotide
cacuccaguugua

SEQ ID NO: 2207 - RNA, 19 nt, Artificial Sequence
  synthetic polynucleotide
uacaacuggagugaaaacu

SEQ ID NO: 2208 - RNA, 13 nt, Artificial Sequence
  synthetic polynucleotide
aaugaaagagaaa

SEQ ID NO: 2209 - RNA, 19 nt, Artificial Sequence
  synthetic polynucleotide
uuucucuuucauuuugcua

SEQ ID NO: 2210 - RNA, 13 nt, Artificial Sequence
  synthetic polynucleotide
ugcagugauuuga

SEQ ID NO: 2211 - RNA, 19 nt, Artificial Sequence
  synthetic polynucleotide
ucaaaucacugcaauucuc

SEQ ID NO: 2212 - RNA, 13 nt, Artificial Sequence
  synthetic polynucleotide
ugaaagagaacaa

SEQ ID NO: 2213 - RNA, 19 nt, Artificial Sequence
  synthetic polynucleotide
uuguucucuuucauuuugc

SEQ ID NO: 2214 - RNA, 13 nt, Artificial Sequence
  synthetic polynucleotide
accugaaauuuca

SEQ ID NO: 2215 - RNA, 19 nt, Artificial Sequence
  synthetic polynucleotide
ugaaauuucagguguuuau

SEQ ID NO: 2216 - RNA, 13 nt, Artificial Sequence
  synthetic polynucleotide
gaauugcagugaa

SEQ ID NO: 2217 - RNA, 19 nt, Artificial Sequence
  synthetic polynucleotide
uucacugcaauucucaugg

SEQ ID NO: 2218 - RNA, 13 nt, Artificial Sequence
  synthetic polynucleotide
ggcugauucugga

SEQ ID NO: 2219 - RNA, 19 nt, Artificial Sequence
  synthetic polynucleotide
uccagaaucagccuguuua

SEQ ID NO: 2220 - RNA, 13 nt, Artificial Sequence
  synthetic polynucleotide
cacauuugauuga

SEQ ID NO: 2221 - RNA, 19 nt, Artificial Sequence
  synthetic polynucleotide
ucaaucaaaugugaucugg

SEQ ID NO: 2222 - RNA, 13 nt, Artificial Sequence
  synthetic polynucleotide
cacugccucaauu

SEQ ID NO: 2223 - RNA, 19 nt, Artificial Sequence
  synthetic polynucleotide
aauugaggcaguguugaug

SEQ ID NO: 2224 - RNA, 13 nt, Artificial Sequence
  synthetic polynucleotide
aaauaccagucuu

SEQ ID NO: 2225 - RNA, 19 nt, Artificial Sequence
  synthetic polynucleotide
aagacugguauuucaucug

SEQ ID NO: 2226 - RNA, 13 nt, Artificial Sequence
  synthetic polynucleotide
cauuugauugaca

SEQ ID NO: 2227 - RNA, 19 nt, Artificial Sequence
  synthetic polynucleotide
ugucaaucaaaugugaucu

SEQ ID NO: 2228 - RNA, 13 nt, Artificial Sequence
  synthetic polynucleotide
gaaaacugcucaa

SEQ ID NO: 2229 - RNA, 19 nt, Artificial Sequence
  synthetic polynucleotide
uugagcaguuuucuccaua

SEQ ID NO: 2230 - RNA, 13 nt, Artificial Sequence
  synthetic polynucleotide
accucuccuauua

SEQ ID NO: 2231 - RNA, 19 nt, Artificial Sequence
  synthetic polynucleotide
uaauaggagagguuagaga

SEQ ID NO: 2232 - RNA, 13 nt, Artificial Sequence
  synthetic polynucleotide
uccaccaacuuaa

SEQ ID NO: 2233 - RNA, 19 nt, Artificial Sequence
  synthetic polynucleotide
uuaaguugguggacuguca

SEQ ID NO: 2234 - RNA, 14 nt, Artificial Sequence
  synthetic polynucleotide
guccaccaacuuaa

SEQ ID NO: 2235 - RNA, 19 nt, Artificial Sequence
  synthetic polynucleotide
uuaaguugguggacuguca

SEQ ID NO: 2236 - RNA, 13 nt, Artificial Sequence
  synthetic polynucleotide
cuccuauuauaca

SEQ ID NO: 2237 - RNA, 19 nt, Artificial Sequence
  synthetic polynucleotide
uguauaauaggagagguua

SEQ ID NO: 2238 - RNA, 13 nt, Artificial Sequence
  synthetic polynucleotide
gaucacauuugaa

SEQ ID NO: 2239 - RNA, 19 nt, Artificial Sequence
  synthetic polynucleotide
uucaaaugugaucuggaug

SEQ ID NO: 2240 - RNA, 14 nt, Artificial Sequence
  synthetic polynucleotide
agaucacauuugaa

SEQ ID NO: 2241 - RNA, 19 nt, Artificial Sequence
  synthetic polynucleotide
uucaaaugugaucuggaug

SEQ ID NO: 2242 - RNA, 13 nt, Artificial Sequence
  synthetic polynucleotide
aaccucuccuaua

SEQ ID NO: 2243 - RNA, 19 nt, Artificial Sequence
  synthetic polynucleotide
uauaggagagguuagagaa

SEQ ID NO: 2244 - RNA, 13 nt, Artificial Sequence
  synthetic polynucleotide
guugacauccaga

SEQ ID NO: 2245 - RNA, 19 nt, Artificial Sequence
  synthetic polynucleotide
ucuggaugucaacacauaa

SEQ ID NO: 2246 - RNA, 13 nt, Artificial Sequence
  synthetic polynucleotide
ccuuccuucgaaa

SEQ ID NO: 2247 - RNA, 19 nt, Artificial Sequence
  synthetic polynucleotide
uuucgaaggaagggaaugu

SEQ ID NO: 2248 - RNA, 13 nt, Artificial Sequence
  synthetic polynucleotide
acuccaaacacaa

SEQ ID NO: 2249 - RNA, 19 nt, Artificial Sequence
  synthetic polynucleotide
uuguguuuggaguggguuu

SEQ ID NO: 2250 - RNA, 14 nt, Artificial Sequence
  synthetic polynucleotide
cacuccaaacacaa

SEQ ID NO: 2251 - RNA, 19 nt, Artificial Sequence
  synthetic polynucleotide
uuguguuuggaguggguuu

SEQ ID NO: 2252 - RNA, 13 nt, Artificial Sequence
  synthetic polynucleotide
cacuccaaacaca

SEQ ID NO: 2253 - RNA, 19 nt, Artificial Sequence
  synthetic polynucleotide
uguguuuggaguggguuuc

SEQ ID NO: 2254 - RNA, 13 nt, Artificial Sequence
  synthetic polynucleotide
ccaccaacuuaca

SEQ ID NO: 2255 - RNA, 19 nt, Artificial Sequence
  synthetic polynucleotide
uguaaguugguggacuguc

SEQ ID NO: 2256 - RNA, 14 nt, Artificial Sequence
  synthetic polynucleotide
uccaccaacuuaca

SEQ ID NO: 2257 - RNA, 19 nt, Artificial Sequence
  synthetic polynucleotide
uguaaguugguggacuguc

SEQ ID NO: 2258 - RNA, 13 nt, Artificial Sequence
  synthetic polynucleotide
aauaccagucuua

SEQ ID NO: 2259 - RNA, 19 nt, Artificial Sequence
  synthetic polynucleotide
uaagacugguauuucaucu

SEQ ID NO: 2260 - RNA, 13 nt, Artificial Sequence
  synthetic polynucleotide
gaccaguauaaga

SEQ ID NO: 2261 - RNA, 19 nt, Artificial Sequence
  synthetic polynucleotide
ucuuauacuggucaaaucc

SEQ ID NO: 2262 - RNA, 13 nt, Artificial Sequence
  synthetic polynucleotide
gucuuuuaaugaa

SEQ ID NO: 2263 - RNA, 19 nt, Artificial Sequence
  synthetic polynucleotide
uucauuaaaagacugguau

SEQ ID NO: 2264 - RNA, 13 nt, Artificial Sequence
  synthetic polynucleotide
aauuucaugucua

SEQ ID NO: 2265 - RNA, 19 nt, Artificial Sequence
  synthetic polynucleotide
uagacaugaaauuacuggu

SEQ ID NO: 2266 - RNA, 13 nt, Artificial Sequence
  synthetic polynucleotide
aucacauuugaua

SEQ ID NO: 2267 - RNA, 19 nt, Artificial Sequence
  synthetic polynucleotide
uaucaaaugugaucuggau

SEQ ID NO: 2268 - RNA, 14 nt, Artificial Sequence
  synthetic polynucleotide
gaucacauuugaua

SEQ ID NO: 2269 - RNA, 19 nt, Artificial Sequence
  synthetic polynucleotide
uaucaaaugugaucuggau

SEQ ID NO: 2270 - RNA, 13 nt, Artificial Sequence
  synthetic polynucleotide
uccagaucacaua

SEQ ID NO: 2271 - RNA, 19 nt, Artificial Sequence
  synthetic polynucleotide
uaugugaucuggaugucaa

SEQ ID NO: 2272 - RNA, 13 nt, Artificial Sequence
  synthetic polynucleotide
uacugauaggaga

SEQ ID NO: 2273 - RNA, 19 nt, Artificial Sequence
  synthetic polynucleotide
ucuccuaucaguauuagcc

SEQ ID NO: 2274 - RNA, 13 nt, Artificial Sequence
  synthetic polynucleotide
gugcaacacuuga

SEQ ID NO: 2275 - RNA, 19 nt, Artificial Sequence
  synthetic polynucleotide
ucaaguguugcacauaauc

SEQ ID NO: 2276 - RNA, 13 nt, Artificial Sequence
  synthetic polynucleotide
accaguauaagua

SEQ ID NO: 2277 - RNA, 19 nt, Artificial Sequence
  synthetic polynucleotide
uacuuauacuggucaaauc

SEQ ID NO: 2278 - RNA, 13 nt, Artificial Sequence
  synthetic polynucleotide
gaagucuaaugaa

SEQ ID NO: 2279 - RNA, 19 nt, Artificial Sequence
  synthetic polynucleotide
uucauuagacuucuacagu

SEQ ID NO: 2280 - RNA, 13 nt, Artificial Sequence
  synthetic polynucleotide
aagaagaaaguua

SEQ ID NO: 2281 - RNA, 19 nt, Artificial Sequence
  synthetic polynucleotide
uaacuuucuucuuagaagc

SEQ ID NO: 2282 - RNA, 13 nt, Artificial Sequence
  synthetic polynucleotide
ucacauuugauua

SEQ ID NO: 2283 - RNA, 19 nt, Artificial Sequence
  synthetic polynucleotide
uaaucaaaugugaucugga

SEQ ID NO: 2284 - RNA, 14 nt, Artificial Sequence
  synthetic polynucleotide
aucacauuugauua

SEQ ID NO: 2285 - RNA, 19 nt, Artificial Sequence
  synthetic polynucleotide
uaaucaaaugugaucugga

SEQ ID NO: 2286 - RNA, 13 nt, Artificial Sequence
  synthetic polynucleotide
acauuugauugaa

SEQ ID NO: 2287 - RNA, 19 nt, Artificial Sequence
  synthetic polynucleotide
uucaaucaaaugugaucug

SEQ ID NO: 2288 - RNA, 14 nt, Artificial Sequence
  synthetic polynucleotide
cacauuugauugaa

SEQ ID NO: 2289 - RNA, 19 nt, Artificial Sequence
  synthetic polynucleotide
uucaaucaaaugugaucug

SEQ ID NO: 2290 - RNA, 13 nt, Artificial Sequence
  synthetic polynucleotide
auuugauugacaa

SEQ ID NO: 2291 - RNA, 19 nt, Artificial Sequence
  synthetic polynucleotide
uugucaaucaaaugugauc

SEQ ID NO: 2292 - RNA, 14 nt, Artificial Sequence
  synthetic polynucleotide
cauuugauugacaa

SEQ ID NO: 2293 - RNA, 19 nt, Artificial Sequence
  synthetic polynucleotide
uugucaaucaaaugugauc

SEQ ID NO: 2294 - RNA, 13 nt, Artificial Sequence
  synthetic polynucleotide
caucugcaauaaa

SEQ ID NO: 2295 - RNA, 19 nt, Artificial Sequence
  synthetic polynucleotide
uuuauugcagaugagagac

SEQ ID NO: 2296 - RNA, 14 nt, Artificial Sequence
  synthetic polynucleotide
ucaucugcaauaaa

SEQ ID NO: 2297 - RNA, 19 nt, Artificial Sequence
  synthetic polynucleotide
uuuauugcagaugagagac

SEQ ID NO: 2298 - RNA, 13 nt, Artificial Sequence
  synthetic polynucleotide
acaggaagaugua

SEQ ID NO: 2299 - RNA, 19 nt, Artificial Sequence
  synthetic polynucleotide
uacaucuuccuguaguaca

SEQ ID NO: 2300 - RNA, 13 nt, Artificial Sequence
  synthetic polynucleotide
gaguggagcgccu

SEQ ID NO: 2301 - RNA, 19 nt, Artificial Sequence
  synthetic polynucleotide
aggcgcuccacucuguggu

SEQ ID NO: 2302 - RNA, 13 nt, Artificial Sequence
  synthetic polynucleotide
cgacuggaagaca

SEQ ID NO: 2303 - RNA, 13 nt, Artificial Sequence
  synthetic polynucleotide
ggagcgccuguuc

SEQ ID NO: 2304 - RNA, 13 nt, Artificial Sequence
  synthetic polynucleotide
gccauuacaacug

SEQ ID NO: 2305 - RNA, 13 nt, Artificial Sequence
  synthetic polynucleotide
gagcuuucuggcu

SEQ ID NO: 2306 - RNA, 13 nt, Artificial Sequence
  synthetic polynucleotide
aguggagcgccug

SEQ ID NO: 2307 - RNA, 13 nt, Artificial Sequence
  synthetic polynucleotide
uggagcgccuguu

SEQ ID NO: 2308 - RNA, 13 nt, Artificial Sequence
  synthetic polynucleotide
guuugagcuuucu

SEQ ID NO: 2309 - RNA, 13 nt, Artificial Sequence
  synthetic polynucleotide
ugccauuacaacu

SEQ ID NO: 2310 - RNA, 13 nt, Artificial Sequence
  synthetic polynucleotide
acuggaagacacg

SEQ ID NO: 2311 - RNA, 13 nt, Artificial Sequence
  synthetic polynucleotide
aacugccuggucc

SEQ ID NO: 2312 - RNA, 13 nt, Artificial Sequence
  synthetic polynucleotide
agaccugugccug

SEQ ID NO: 2313 - RNA, 13 nt, Artificial Sequence
  synthetic polynucleotide
cagaguggagcgc

SEQ ID NO: 2314 - RNA, 13 nt, Artificial Sequence
  synthetic polynucleotide
ccugguccagacc

SEQ ID NO: 2315 - RNA, 13 nt, Artificial Sequence
  synthetic polynucleotide
ccauuacaacugu

SEQ ID NO: 2316 - RNA, 13 nt, Artificial Sequence
  synthetic polynucleotide
cugccauuacaac

SEQ ID NO: 2317 - RNA, 13 nt, Artificial Sequence
  synthetic polynucleotide
auuacaacugucc

SEQ ID NO: 2318 - RNA, 13 nt, Artificial Sequence
  synthetic polynucleotide
cauuacaacuguc

SEQ ID NO: 2319 - RNA, 13 nt, Artificial Sequence
  synthetic polynucleotide
agaguggagcgcc

SEQ ID NO: 2320 - RNA, 13 nt, Artificial Sequence
  synthetic polynucleotide
accgacuggaaga

SEQ ID NO: 2321 - RNA, 13 nt, Artificial Sequence
  synthetic polynucleotide
auguacggagaca

SEQ ID NO: 2322 - RNA, 13 nt, Artificial Sequence
  synthetic polynucleotide
gccuugcgaagcu

SEQ ID NO: 2323 - RNA, 13 nt, Artificial Sequence
  synthetic polynucleotide
gcugcgaggagug

SEQ ID NO: 2324 - RNA, 13 nt, Artificial Sequence
  synthetic polynucleotide
gccuaucaaguuu

SEQ ID NO: 2325 - RNA, 13 nt, Artificial Sequence
  synthetic polynucleotide
aauucuguggagu

SEQ ID NO: 2326 - RNA, 13 nt, Artificial Sequence
  synthetic polynucleotide
uguacggagacau

SEQ ID NO: 2327 - RNA, 13 nt, Artificial Sequence
  synthetic polynucleotide
agccuaucaaguu

SEQ ID NO: 2328 - RNA, 13 nt, Artificial Sequence
  synthetic polynucleotide
caaguuugagcuu

SEQ ID NO: 2329 - RNA, 13 nt, Artificial Sequence
  synthetic polynucleotide
cuguggaguaugu

SEQ ID NO: 2330 - RNA, 13 nt, Artificial Sequence
  synthetic polynucleotide
aaauucuguggag

SEQ ID NO: 2331 - RNA, 13 nt, Artificial Sequence
  synthetic polynucleotide
uuucaguagcaca

SEQ ID NO: 2332 - RNA, 13 nt, Artificial Sequence
  synthetic polynucleotide
caaugacaucuuu

SEQ ID NO: 2333 - RNA, 13 nt, Artificial Sequence
  synthetic polynucleotide
aguaccagugcac

SEQ ID NO: 2334 - RNA, 13 nt, Artificial Sequence
  synthetic polynucleotide
ggaagacacguuu

SEQ ID NO: 2335 - RNA, 13 nt, Artificial Sequence
  synthetic polynucleotide
cuaucaaguuuga

SEQ ID NO: 2336 - RNA, 13 nt, Artificial Sequence
  synthetic polynucleotide
agcuaaauucugu

SEQ ID NO: 2337 - RNA, 13 nt, Artificial Sequence
  synthetic polynucleotide
agguagaauguaa

SEQ ID NO: 2338 - RNA, 13 nt, Artificial Sequence
  synthetic polynucleotide
agcugaucaguuu

SEQ ID NO: 2339 - RNA, 13 nt, Artificial Sequence
  synthetic polynucleotide
uucugcucagaua

SEQ ID NO: 2340 - RNA, 13 nt, Artificial Sequence
  synthetic polynucleotide
uuaucuaaguuaa

SEQ ID NO: 2341 - RNA, 13 nt, Artificial Sequence
  synthetic polynucleotide
uauacgaguaaua

SEQ ID NO: 2342 - RNA, 13 nt, Artificial Sequence
  synthetic polynucleotide
gacuggacagcuu

SEQ ID NO: 2343 - RNA, 13 nt, Artificial Sequence
  synthetic polynucleotide
auggccuuuauua

SEQ ID NO: 2344 - RNA, 13 nt, Artificial Sequence
  synthetic polynucleotide
auaccgagcuaaa

SEQ ID NO: 2345 - RNA, 13 nt, Artificial Sequence
  synthetic polynucleotide
uuguugagagugu

SEQ ID NO: 2346 - RNA, 13 nt, Artificial Sequence
  synthetic polynucleotide
acauaccgagcua

SEQ ID NO: 2347 - RNA, 13 nt, Artificial Sequence
  synthetic polynucleotide
agcagaaagguua

SEQ ID NO: 2348 - RNA, 13 nt, Artificial Sequence
  synthetic polynucleotide
aguuguuccuuaa

SEQ ID NO: 2349 - RNA, 13 nt, Artificial Sequence
  synthetic polynucleotide
auuugaaguguaa

SEQ ID NO: 2350 - RNA, 13 nt, Artificial Sequence
  synthetic polynucleotide
aagcugaccugga

SEQ ID NO: 2351 - RNA, 13 nt, Artificial Sequence
  synthetic polynucleotide
ggucaugaagaag

SEQ ID NO: 2352 - RNA, 13 nt, Artificial Sequence
  synthetic polynucleotide
auggucaggccuu

SEQ ID NO: 2353 - RNA, 13 nt, Artificial Sequence
  synthetic polynucleotide
gaagacacguuug

SEQ ID NO: 2354 - RNA, 13 nt, Artificial Sequence
  synthetic polynucleotide
aggccuugcgaag

SEQ ID NO: 2355 - RNA, 13 nt, Artificial Sequence
  synthetic polynucleotide
uaccgacuggaag

SEQ ID NO: 2356 - RNA, 13 nt, Artificial Sequence
  synthetic polynucleotide
accgcaagaucgg

SEQ ID NO: 2357 - RNA, 13 nt, Artificial Sequence
  synthetic polynucleotide
caggccuugcgaa

SEQ ID NO: 2358 - RNA, 13 nt, Artificial Sequence
  synthetic polynucleotide
cgagcuaaauucu

SEQ ID NO: 2359 - RNA, 13 nt, Artificial Sequence
  synthetic polynucleotide
ucuguggaguaug

SEQ ID NO: 2360 - RNA, 13 nt, Artificial Sequence
  synthetic polynucleotide
cggagacauggca

SEQ ID NO: 2361 - RNA, 13 nt, Artificial Sequence
  synthetic polynucleotide
augacaacgccuc

SEQ ID NO: 2362 - RNA, 13 nt, Artificial Sequence
  synthetic polynucleotide
gaggucaugaaga

SEQ ID NO: 2363 - RNA, 13 nt, Artificial Sequence
  synthetic polynucleotide
uaaauucugugga

SEQ ID NO: 2364 - RNA, 13 nt, Artificial Sequence
  synthetic polynucleotide
uggaagacacguu

SEQ ID NO: 2365 - RNA, 13 nt, Artificial Sequence
  synthetic polynucleotide
aagauguacggag

SEQ ID NO: 2366 - RNA, 13 nt, Artificial Sequence
  synthetic polynucleotide
aaugacaacgccu

SEQ ID NO: 2367 - RNA, 13 nt, Artificial Sequence
  synthetic polynucleotide
ggcgaggucauga

SEQ ID NO: 2368 - RNA, 13 nt, Artificial Sequence
  synthetic polynucleotide
gacacguuuggcc

SEQ ID NO: 2369 - RNA, 13 nt, Artificial Sequence
  synthetic polynucleotide
acggagacauggc

SEQ ID NO: 2370 - RNA, 13 nt, Artificial Sequence
  synthetic polynucleotide
ucaggccuugcga

SEQ ID NO: 2371 - RNA, 13 nt, Artificial Sequence
  synthetic polynucleotide
gcgaagcugaccu

SEQ ID NO: 2372 - RNA, 13 nt, Artificial Sequence
  synthetic polynucleotide
ggaagauguacgg

SEQ ID NO: 2373 - RNA, 13 nt, Artificial Sequence
  synthetic polynucleotide
gugacuucggcuc

SEQ ID NO: 2374 - RNA, 13 nt, Artificial Sequence
  synthetic polynucleotide
ugacuucggcucc

SEQ ID NO: 2375 - RNA, 13 nt, Artificial Sequence
  synthetic polynucleotide
uggucaggccuug

SEQ ID NO: 2376 - RNA, 13 nt, Artificial Sequence
  synthetic polynucleotide
ucaaguuugagcu

SEQ ID NO: 2377 - RNA, 13 nt, Artificial Sequence
  synthetic polynucleotide
gccagaacugcag

SEQ ID NO: 2378 - RNA, 13 nt, Artificial Sequence
  synthetic polynucleotide
uggaguauguacc

SEQ ID NO: 2379 - RNA, 13 nt, Artificial Sequence
  synthetic polynucleotide
gcuagagaagcag

SEQ ID NO: 2380 - RNA, 13 nt, Artificial Sequence
  synthetic polynucleotide
ggucaggccuugc

SEQ ID NO: 2381 - RNA, 13 nt, Artificial Sequence
  synthetic polynucleotide
gagcuaaauucug

SEQ ID NO: 2382 - RNA, 13 nt, Artificial Sequence
  synthetic polynucleotide
aagacacguuugg

SEQ ID NO: 2383 - RNA, 13 nt, Artificial Sequence
  synthetic polynucleotide
cgaggucaugaag

SEQ ID NO: 2384 - RNA, 13 nt, Artificial Sequence
  synthetic polynucleotide
ggccuugcgaagc

SEQ ID NO: 2385 - RNA, 13 nt, Artificial Sequence
  synthetic polynucleotide
cuugcgaagcuga

SEQ ID NO: 2386 - RNA, 13 nt, Artificial Sequence
  synthetic polynucleotide
ccgacuggaagac

SEQ ID NO: 2387 - RNA, 13 nt, Artificial Sequence
  synthetic polynucleotide
ccuaucaaguuug

SEQ ID NO: 2388 - RNA, 13 nt, Artificial Sequence
  synthetic polynucleotide
uguuccaagaccu

SEQ ID NO: 2389 - RNA, 13 nt, Artificial Sequence
  synthetic polynucleotide
cgaagcugaccug

SEQ ID NO: 2390 - RNA, 13 nt, Artificial Sequence
  synthetic polynucleotide
uugcgaagcugac

SEQ ID NO: 2391 - RNA, 13 nt, Artificial Sequence
  synthetic polynucleotide
caaugacaacgcc

SEQ ID NO: 2392 - RNA, 13 nt, Artificial Sequence
  synthetic polynucleotide
guaccagugcacg

SEQ ID NO: 2393 - RNA, 13 nt, Artificial Sequence
  synthetic polynucleotide
ccuguuccaagac

SEQ ID NO: 2394 - RNA, 13 nt, Artificial Sequence
  synthetic polynucleotide
uacggagacaugg

SEQ ID NO: 2395 - RNA, 13 nt, Artificial Sequence
  synthetic polynucleotide
ugcgaagcugacc

SEQ ID NO: 2396 - RNA, 13 nt, Artificial Sequence
  synthetic polynucleotide
ccuugcgaagcug

SEQ ID NO: 2397 - RNA, 13 nt, Artificial Sequence
  synthetic polynucleotide
cugugacuucggc

SEQ ID NO: 2398 - RNA, 13 nt, Artificial Sequence
  synthetic polynucleotide
gcuaaauucugug

SEQ ID NO: 2399 - RNA, 13 nt, Artificial Sequence
  synthetic polynucleotide
cuaaauucugugg

SEQ ID NO: 2400 - RNA, 13 nt, Artificial Sequence
  synthetic polynucleotide
agacacguuuggc

SEQ ID NO: 2401 - RNA, 13 nt, Artificial Sequence
  synthetic polynucleotide
ccgcaagaucggc

SEQ ID NO: 2402 - RNA, 13 nt, Artificial Sequence
  synthetic polynucleotide
uaucaaguuugag

SEQ ID NO: 2403 - RNA, 13 nt, Artificial Sequence
  synthetic polynucleotide
gaagcugaccugg

SEQ ID NO: 2404 - RNA, 13 nt, Artificial Sequence
  synthetic polynucleotide
acauuaacucaua

SEQ ID NO: 2405 - RNA, 14 nt, Artificial Sequence
  synthetic polynucleotide
gacauuaacucaua

SEQ ID NO: 2406 - RNA, 19 nt, Artificial Sequence
  synthetic polynucleotide
uaugaguuaaugucucuca

SEQ ID NO: 2407 - RNA, 13 nt, Artificial Sequence
  synthetic polynucleotide
ugaagaauguuaa

SEQ ID NO: 2408 - RNA, 19 nt, Artificial Sequence
  synthetic polynucleotide
uuaacauucuucaaaccag

SEQ ID NO: 2409 - RNA, 14 nt, Artificial Sequence
  synthetic polynucleotide
uugaagaauguuaa

SEQ ID NO: 2410 - RNA, 19 nt, Artificial Sequence
  synthetic polynucleotide
uuaacauucuucaaaccag

SEQ ID NO: 2411 - RNA, 13 nt, Artificial Sequence
  synthetic polynucleotide
gauagcaucuuaa

SEQ ID NO: 2412 - RNA, 19 nt, Artificial Sequence
  synthetic polynucleotide
uuaagaugcuaucugauga

SEQ ID NO: 2413 - RNA, 14 nt, Artificial Sequence
  synthetic polynucleotide
agauagcaucuuaa

SEQ ID NO: 2414 - RNA, 19 nt, Artificial Sequence
  synthetic polynucleotide
uuaagaugcuaucugauga

SEQ ID NO: 2415 - RNA, 13 nt, Artificial Sequence
  synthetic polynucleotide
ugaaguguaauua

SEQ ID NO: 2416 - RNA, 19 nt, Artificial Sequence
  synthetic polynucleotide
uaauuacacuucaaauagc

SEQ ID NO: 2417 - RNA, 13 nt, Artificial Sequence
  synthetic polynucleotide
aauugagaaggaa

SEQ ID NO: 2418 - RNA, 19 nt, Artificial Sequence
  synthetic polynucleotide
uuccuucucaauuacacuu

SEQ ID NO: 2419 - RNA, 13 nt, Artificial Sequence
  synthetic polynucleotide
uugagaaggaaaa

SEQ ID NO: 2420 - RNA, 19 nt, Artificial Sequence
  synthetic polynucleotide
uuuuccuucucaauuacac

SEQ ID NO: 2421 - RNA, 13 nt, Artificial Sequence
  synthetic polynucleotide
cauucugauucga

SEQ ID NO: 2422 - RNA, 19 nt, Artificial Sequence
  synthetic polynucleotide
ucgaaucagaaugucagag

SEQ ID NO: 2423 - RNA, 13 nt, Artificial Sequence
  synthetic polynucleotide
uucugauucgaaa

SEQ ID NO: 2424 - RNA, 19 nt, Artificial Sequence
  synthetic polynucleotide
uuucgaaucagaaugucag

SEQ ID NO: 2425 - RNA, 13 nt, Artificial Sequence
  synthetic polynucleotide
cugucgauuagaa

SEQ ID NO: 2426 - RNA, 19 nt, Artificial Sequence
  synthetic polynucleotide
uucuaaucgacaggauucc

SEQ ID NO: 2427 - RNA, 13 nt, Artificial Sequence
  synthetic polynucleotide
uuugccuguaaca

SEQ ID NO: 2428 - RNA, 19 nt, Artificial Sequence
  synthetic polynucleotide
uguuacaggcaaauucacu

SEQ ID NO: 2429 - RNA, 14 nt, Artificial Sequence
  synthetic polynucleotide
auuugccuguaaca

SEQ ID NO: 2430 - RNA, 19 nt, Artificial Sequence
  synthetic polynucleotide
uguuacaggcaaauucacu

SEQ ID NO: 2431 - RNA, 13 nt, Artificial Sequence
  synthetic polynucleotide
acaagccagauua

SEQ ID NO: 2432 - RNA, 19 nt, Artificial Sequence
  synthetic polynucleotide
uaaucuggcuuguuacagg

SEQ ID NO: 2433 - RNA, 14 nt, Artificial Sequence
  synthetic polynucleotide
aacaagccagauua

SEQ ID NO: 2434 - RNA, 19 nt, Artificial Sequence
  synthetic polynucleotide
uaaucuggcuuguuacagg

SEQ ID NO: 2435 - RNA, 13 nt, Artificial Sequence
  synthetic polynucleotide
caguuuauuugua

SEQ ID NO: 2436 - RNA, 19 nt, Artificial Sequence
  synthetic polynucleotide
uacaaauaaacuguccgaa

SEQ ID NO: 2437 - RNA, 13 nt, Artificial Sequence
  synthetic polynucleotide
uguugagagugua

SEQ ID NO: 2438 - RNA, 19 nt, Artificial Sequence
  synthetic polynucleotide
uacacucucaacaaauaaa

SEQ ID NO: 2439 - RNA, 14 nt, Artificial Sequence
  synthetic polynucleotide
uuguugagagugua

SEQ ID NO: 2440 - RNA, 19 nt, Artificial Sequence
  synthetic polynucleotide
uacacucucaacaaauaaa

SEQ ID NO: 2441 - RNA, 13 nt, Artificial Sequence
  synthetic polynucleotide
ugcaccuuucuaa

SEQ ID NO: 2442 - RNA, 19 nt, Artificial Sequence
  synthetic polynucleotide
uuagaaaggugcaaacaug

SEQ ID NO: 2443 - RNA, 14 nt, Artificial Sequence
  synthetic polynucleotide
uugcaccuuucuaa

SEQ ID NO: 2444 - RNA, 19 nt, Artificial Sequence
  synthetic polynucleotide
uuagaaaggugcaaacaug

SEQ ID NO: 2445 - RNA, 13 nt, Artificial Sequence
  synthetic polynucleotide
uugagcuuucuga

SEQ ID NO: 2446 - RNA, 19 nt, Artificial Sequence
  synthetic polynucleotide
ucagaaagcucaaacuuga

SEQ ID NO: 2447 - RNA, 13 nt, Artificial Sequence
  synthetic polynucleotide
ugagagugugaca

SEQ ID NO: 2448 - RNA, 19 nt, Artificial Sequence
  synthetic polynucleotide
ugucacacucucaacaaau

SEQ ID NO: 2449 - RNA, 13 nt, Artificial Sequence
  synthetic polynucleotide
agugugaccaaaa

SEQ ID NO: 2450 - RNA, 19 nt, Artificial Sequence
  synthetic polynucleotide
uuuuggucacacucucaac

SEQ ID NO: 2451 - RNA, 14 nt, Artificial Sequence
  synthetic polynucleotide
gagugugaccaaaa

SEQ ID NO: 2452 - RNA, 19 nt, Artificial Sequence
  synthetic polynucleotide
uuuuggucacacucucaac

SEQ ID NO: 2453 - RNA, 13 nt, Artificial Sequence
  synthetic polynucleotide
gugugaccaaaaa

SEQ ID NO: 2454 - RNA, 19 nt, Artificial Sequence
  synthetic polynucleotide
uuuuuggucacacucucaa

SEQ ID NO: 2455 - RNA, 13 nt, Artificial Sequence
  synthetic polynucleotide
ugugaccaaaaga

SEQ ID NO: 2456 - RNA, 19 nt, Artificial Sequence
  synthetic polynucleotide
ucuuuuggucacacucuca

SEQ ID NO: 2457 - RNA, 14 nt, Artificial Sequence
  synthetic polynucleotide
gugugaccaaaaga

SEQ ID NO: 2458 - RNA, 19 nt, Artificial Sequence
  synthetic polynucleotide
ucuuuuggucacacucuca

SEQ ID NO: 2459 - RNA, 13 nt, Artificial Sequence
  synthetic polynucleotide
gugaccaaaagua

SEQ ID NO: 2460 - RNA, 19 nt, Artificial Sequence
  synthetic polynucleotide
uacuuuuggucacacucuc

SEQ ID NO: 2461 - RNA, 13 nt, Artificial Sequence
  synthetic polynucleotide
gaccaaaaguuaa

SEQ ID NO: 2462 - RNA, 19 nt, Artificial Sequence
  synthetic polynucleotide
uuaacuuuuggucacacuc

SEQ ID NO: 2463 - RNA, 13 nt, Artificial Sequence
  synthetic polynucleotide
gcaccuuucuaga

SEQ ID NO: 2464 - RNA, 19 nt, Artificial Sequence
  synthetic polynucleotide
ucuagaaaggugcaaacau

SEQ ID NO: 2465 - RNA, 13 nt, Artificial Sequence
  synthetic polynucleotide
ccuuucuaguuga

SEQ ID NO: 2466 - RNA, 19 nt, Artificial Sequence
  synthetic polynucleotide
ucaacuagaaaggugcaaa

SEQ ID NO: 2467 - RNA, 13 nt, Artificial Sequence
  synthetic polynucleotide
ggcucuccuucga

SEQ ID NO: 2468 - RNA, 19 nt, Artificial Sequence
  synthetic polynucleotide
ucgaaggagagccauucgc

SEQ ID NO: 2469 - RNA, 13 nt, Artificial Sequence
  synthetic polynucleotide
gacaggaaccugg

SEQ ID NO: 2470 - RNA, 19 nt, Artificial Sequence
  synthetic polynucleotide
ccagguuccugucuuuaug

SEQ ID NO: 2471 - RNA, 13 nt, Artificial Sequence
  synthetic polynucleotide
ccaaggagguuua

SEQ ID NO: 2472 - RNA, 19 nt, Artificial Sequence
  synthetic polynucleotide
uaaaccuccuuggcguagu

SEQ ID NO: 2473 - RNA, 13 nt, Artificial Sequence
  synthetic polynucleotide
auuuccaucuaca

SEQ ID NO: 2474 - RNA, 19 nt, Artificial Sequence
  synthetic polynucleotide
uguagauggaaaucaccuc

SEQ ID NO: 2475 - RNA, 13 nt, Artificial Sequence
  synthetic polynucleotide
uccaucuacaaca

SEQ ID NO: 2476 - RNA, 19 nt, Artificial Sequence
  synthetic polynucleotide
uguuguagauggaaaucac

SEQ ID NO: 2477 - RNA, 13 nt, Artificial Sequence
  synthetic polynucleotide
uuuccaucuacaa

SEQ ID NO: 2478 - RNA, 19 nt, Artificial Sequence
  synthetic polynucleotide
uuguagauggaaaucaccu

SEQ ID NO: 2479 - RNA, 13 nt, Artificial Sequence
  synthetic polynucleotide
cgccaaggagguu

SEQ ID NO: 2480 - RNA, 19 nt, Artificial Sequence
  synthetic polynucleotide
aaccuccuuggcguaguac

SEQ ID NO: 2481 - RNA, 13 nt, Artificial Sequence
  synthetic polynucleotide
guggugaucagaa

SEQ ID NO: 2482 - RNA, 19 nt, Artificial Sequence
  synthetic polynucleotide
uucugaucaccacugguau

SEQ ID NO: 2483 - RNA, 13 nt, Artificial Sequence
  synthetic polynucleotide
cuccugcuaaugu

SEQ ID NO: 2484 - RNA, 19 nt, Artificial Sequence
  synthetic polynucleotide
acauuagcaggagaugugg

SEQ ID NO: 2485 - RNA, 13 nt, Artificial Sequence
  synthetic polynucleotide
accuccacauaua

SEQ ID NO: 2486 - RNA, 19 nt, Artificial Sequence
  synthetic polynucleotide
uauauguggaggugccauc

SEQ ID NO: 2487 - RNA, 13 nt, Artificial Sequence
  synthetic polynucleotide
aaguccacuagga

SEQ ID NO: 2488 - RNA, 19 nt, Artificial Sequence
  synthetic polynucleotide
uccuaguggacuuuauagu

SEQ ID NO: 2489 - RNA, 13 nt, Artificial Sequence
  synthetic polynucleotide
uggugaucagaaa

SEQ ID NO: 2490 - RNA, 19 nt, Artificial Sequence
  synthetic polynucleotide
uuucugaucaccacuggua

SEQ ID NO: 2491 - RNA, 13 nt, Artificial Sequence
  synthetic polynucleotide
aguccacuaggaa

SEQ ID NO: 2492 - RNA, 19 nt, Artificial Sequence
  synthetic polynucleotide
uuccuaguggacuuuauag

SEQ ID NO: 2493 - RNA, 13 nt, Artificial Sequence
  synthetic polynucleotide
acgccaaggaggu

SEQ ID NO: 2494 - RNA, 19 nt, Artificial Sequence
  synthetic polynucleotide
accuccuuggcguaguacu

SEQ ID NO: 2495 - RNA, 13 nt, Artificial Sequence
  synthetic polynucleotide
uauuuauugugua

SEQ ID NO: 2496 - RNA, 19 nt, Artificial Sequence
  synthetic polynucleotide
uacacaauaaauaacucac

SEQ ID NO: 2497 - RNA, 14 nt, Artificial Sequence
  synthetic polynucleotide
uuauuuauugugua

SEQ ID NO: 2498 - RNA, 19 nt, Artificial Sequence
  synthetic polynucleotide
uacacaauaaauaacucac

SEQ ID NO: 2499 - RNA, 13 nt, Artificial Sequence
  synthetic polynucleotide
aucaguguuaaaa

SEQ ID NO: 2500 - RNA, 19 nt, Artificial Sequence
  synthetic polynucleotide
uuuuaacacugaugaacca

SEQ ID NO: 2501 - RNA, 14 nt, Artificial Sequence
  synthetic polynucleotide
caucaguguuaaaa

SEQ ID NO: 2502 - RNA, 19 nt, Artificial Sequence
  synthetic polynucleotide
uuuuaacacugaugaacca

SEQ ID NO: 2503 - RNA, 13 nt, Artificial Sequence
  synthetic polynucleotide
auggcuuaaggaa

SEQ ID NO: 2504 - RNA, 19 nt, Artificial Sequence
  synthetic polynucleotide
uuccuuaagccauccauga

SEQ ID NO: 2505 - RNA, 14 nt, Artificial Sequence
  synthetic polynucleotide
gauggcuuaaggaa

SEQ ID NO: 2506 - RNA, 19 nt, Artificial Sequence
  synthetic polynucleotide
uuccuuaagccauccauga

SEQ ID NO: 2507 - RNA, 13 nt, Artificial Sequence
  synthetic polynucleotide
uuguguucuguua

SEQ ID NO: 2508 - RNA, 19 nt, Artificial Sequence
  synthetic polynucleotide
uaacagaacacaaacuucc

SEQ ID NO: 2509 - RNA, 14 nt, Artificial Sequence
  synthetic polynucleotide
uuuguguucuguua

SEQ ID NO: 2510 - RNA, 19 nt, Artificial Sequence
  synthetic polynucleotide
uaacagaacacaaacuucc

SEQ ID NO: 2511 - RNA, 13 nt, Artificial Sequence
  synthetic polynucleotide
aaauacuuugcca

SEQ ID NO: 2512 - RNA, 19 nt, Artificial Sequence
  synthetic polynucleotide
uggcaaaguauuuggucuc

SEQ ID NO: 2513 - RNA, 14 nt, Artificial Sequence
  synthetic polynucleotide
caaauacuuugcca

SEQ ID NO: 2514 - RNA, 19 nt, Artificial Sequence
  synthetic polynucleotide
uggcaaaguauuuggucuc

SEQ ID NO: 2515 - RNA, 13 nt, Artificial Sequence
  synthetic polynucleotide
cuugcacuacaaa

SEQ ID NO: 2516 - RNA, 19 nt, Artificial Sequence
  synthetic polynucleotide
uuuguagugcaagucaaac

SEQ ID NO: 2517 - RNA, 14 nt, Artificial Sequence
  synthetic polynucleotide
acuugcacuacaaa

SEQ ID NO: 2518 - RNA, 19 nt, Artificial Sequence
  synthetic polynucleotide
uuuguagugcaagucaaac

SEQ ID NO: 2519 - RNA, 13 nt, Artificial Sequence
  synthetic polynucleotide
gaauuuauuagua

SEQ ID NO: 2520 - RNA, 19 nt, Artificial Sequence
  synthetic polynucleotide
uacuaauaaauucuuccag

SEQ ID NO: 2521 - RNA, 14 nt, Artificial Sequence
  synthetic polynucleotide
agaauuuauuagua

SEQ ID NO: 2522 - RNA, 19 nt, Artificial Sequence
  synthetic polynucleotide
uacuaauaaauucuuccag

SEQ ID NO: 2523 - RNA, 13 nt, Artificial Sequence
  synthetic polynucleotide
uugcacuacaaaa

SEQ ID NO: 2524 - RNA, 19 nt, Artificial Sequence
  synthetic polynucleotide
uuuuguagugcaagucaaa

SEQ ID NO: 2525 - RNA, 14 nt, Artificial Sequence
  synthetic polynucleotide
cuugcacuacaaaa

SEQ ID NO: 2526 - RNA, 19 nt, Artificial Sequence
  synthetic polynucleotide
uuuuguagugcaagucaaa

SEQ ID NO: 2527 - RNA, 13 nt, Artificial Sequence
  synthetic polynucleotide
auaaaacagguga

SEQ ID NO: 2528 - RNA, 19 nt, Artificial Sequence
  synthetic polynucleotide
ucaccuguuuuauuuucca

SEQ ID NO: 2529 - RNA, 14 nt, Artificial Sequence
  synthetic polynucleotide
aauaaaacagguga

SEQ ID NO: 2530 - RNA, 19 nt, Artificial Sequence
  synthetic polynucleotide
ucaccuguuuuauuuucca

SEQ ID NO: 2531 - RNA, 13 nt, Artificial Sequence
  synthetic polynucleotide
gacaacaacaaca

SEQ ID NO: 2532 - RNA, 19 nt, Artificial Sequence
  synthetic polynucleotide
uguuguuguugucguuguu

SEQ ID NO: 2533 - RNA, 13 nt, Artificial Sequence
  synthetic polynucleotide
augcuuguaacaa

SEQ ID NO: 2534 - RNA, 19 nt, Artificial Sequence
  synthetic polynucleotide
uuguuacaagcaucaucgu

SEQ ID NO: 2535 - RNA, 13 nt, Artificial Sequence
  synthetic polynucleotide
cagaaacucauga

SEQ ID NO: 2536 - RNA, 19 nt, Artificial Sequence
  synthetic polynucleotide
ucaugaguuucuggcaaag

SEQ ID NO: 2537 - RNA, 13 nt, Artificial Sequence
  synthetic polynucleotide
guauugcuaugca

SEQ ID NO: 2538 - RNA, 19 nt, Artificial Sequence
  synthetic polynucleotide
ugcauagcaauacagaaaa

SEQ ID NO: 2539 - RNA, 13 nt, Artificial Sequence
  synthetic polynucleotide
ccagaaacucaua

SEQ ID NO: 2540 - RNA, 19 nt, Artificial Sequence
  synthetic polynucleotide
uaugaguuucuggcaaagu

SEQ ID NO: 2541 - RNA, 13 nt, Artificial Sequence
  synthetic polynucleotide
acucaaacgagca

SEQ ID NO: 2542 - RNA, 19 nt, Artificial Sequence
  synthetic polynucleotide
ugcucguuugaguucaagu

SEQ ID NO: 2543 - RNA, 13 nt, Artificial Sequence
  synthetic polynucleotide
auaugaccgagaa

SEQ ID NO: 2544 - RNA, 19 nt, Artificial Sequence
  synthetic polynucleotide
uucucggucauauaauaac

SEQ ID NO: 2545 - RNA, 13 nt, Artificial Sequence
  synthetic polynucleotide
cgacgacaacgaa

SEQ ID NO: 2546 - RNA, 19 nt, Artificial Sequence
  synthetic polynucleotide
uucguugucgucgucauca

SEQ ID NO: 2547 - RNA, 13 nt, Artificial Sequence
  synthetic polynucleotide
guaaaccagugaa

SEQ ID NO: 2548 - RNA, 19 nt, Artificial Sequence
  synthetic polynucleotide
uucacugguuuacuaaacu

SEQ ID NO: 2549 - RNA, 13 nt, Artificial Sequence
  synthetic polynucleotide
uugucaguuuaga

SEQ ID NO: 2550 - RNA, 19 nt, Artificial Sequence
  synthetic polynucleotide
ucuaaacugacaaagaacc

SEQ ID NO: 2551 - RNA, 13 nt, Artificial Sequence
  synthetic polynucleotide
ucaucaguguuaa

SEQ ID NO: 2552 - RNA, 19 nt, Artificial Sequence
  synthetic polynucleotide
uuaacacugaugaaccaag

SEQ ID NO: 2553 - RNA, 13 nt, Artificial Sequence
  synthetic polynucleotide
aacucaaacgaga

SEQ ID NO: 2554 - RNA, 19 nt, Artificial Sequence
  synthetic polynucleotide
ucucguuugaguucaaguu

SEQ ID NO: 2555 - RNA, 13 nt, Artificial Sequence
  synthetic polynucleotide
cgacaacaacaaa

SEQ ID NO: 2556 - RNA, 19 nt, Artificial Sequence
  synthetic polynucleotide
uuuguuguugucguuguuc

SEQ ID NO: 2557 - RNA, 13 nt, Artificial Sequence
  synthetic polynucleotide
acgacaacgauga

SEQ ID NO: 2558 - RNA, 19 nt, Artificial Sequence
  synthetic polynucleotide
ucaucguugucgucgucau

SEQ ID NO: 2559 - RNA, 13 nt, Artificial Sequence
  synthetic polynucleotide
gcugccuaaggaa

SEQ ID NO: 2560 - RNA, 19 nt, Artificial Sequence
  synthetic polynucleotide
uuccuuaggcagcugauac

SEQ ID NO: 2561 - RNA, 13 nt, Artificial Sequence
  synthetic polynucleotide
auucuacauuuca

SEQ ID NO: 2562 - RNA, 19 nt, Artificial Sequence
  synthetic polynucleotide
ugaaauguagaauaaggcc

SEQ ID NO: 2563 - RNA, 13 nt, Artificial Sequence
  synthetic polynucleotide
gcuaaugguggaa

SEQ ID NO: 2564 - RNA, 19 nt, Artificial Sequence
  synthetic polynucleotide
uuccaccauuagcacgcgg

SEQ ID NO: 2565 - RNA, 13 nt, Artificial Sequence
  synthetic polynucleotide
ugaucgugcgcuc

SEQ ID NO: 2566 - RNA, 19 nt, Artificial Sequence
  synthetic polynucleotide
gagcgcacgaucauguugg

SEQ ID NO: 2567 - RNA, 13 nt, Artificial Sequence
  synthetic polynucleotide
caauuccuggcga

SEQ ID NO: 2568 - RNA, 19 nt, Artificial Sequence
  synthetic polynucleotide
ucgccaggaauuguugcug

SEQ ID NO: 2569 - RNA, 13 nt, Artificial Sequence
  synthetic polynucleotide
aguggauccacga

SEQ ID NO: 2570 - RNA, 19 nt, Artificial Sequence
  synthetic polynucleotide
ucguggauccacuuccagc

SEQ ID NO: 2571 - RNA, 13 nt, Artificial Sequence
  synthetic polynucleotide
uacagcaaggucc

SEQ ID NO: 2572 - RNA, 19 nt, Artificial Sequence
  synthetic polynucleotide
ggaccuugcuguacugcgu

SEQ ID NO: 2573 - RNA, 13 nt, Artificial Sequence
  synthetic polynucleotide
aacaugaucgugc

SEQ ID NO: 2574 - RNA, 19 nt, Artificial Sequence
  synthetic polynucleotide
gcacgaucauguuggacag

SEQ ID NO: 2575 - RNA, 13 nt, Artificial Sequence
  synthetic polynucleotide
acaugaucgugcg

SEQ ID NO: 2576 - RNA, 19 nt, Artificial Sequence
  synthetic polynucleotide
cgcacgaucauguuggaca

SEQ ID NO: 2577 - RNA, 13 nt, Artificial Sequence
  synthetic polynucleotide
cagcaagguccug

SEQ ID NO: 2578 - RNA, 19 nt, Artificial Sequence
  synthetic polynucleotide
caggaccuugcuguacugc

SEQ ID NO: 2579 - RNA, 13 nt, Artificial Sequence
  synthetic polynucleotide
ccaacaugaucgu

SEQ ID NO: 2580 - RNA, 19 nt, Artificial Sequence
  synthetic polynucleotide
acgaucauguuggacagcu

SEQ ID NO: 2581 - RNA, 13 nt, Artificial Sequence
  synthetic polynucleotide
agcggaagcgcau

SEQ ID NO: 2582 - RNA, 19 nt, Artificial Sequence
  synthetic polynucleotide
augcgcuuccgcuucacca

SEQ ID NO: 2583 - RNA, 13 nt, Artificial Sequence
  synthetic polynucleotide
gcaucgaggccau

SEQ ID NO: 2584 - RNA, 19 nt, Artificial Sequence
  synthetic polynucleotide
auggccucgaugcgcuucc

SEQ ID NO: 2585 - RNA, 13 nt, Artificial Sequence
  synthetic polynucleotide
gacuaucgacaug

SEQ ID NO: 2586 - RNA, 19 nt, Artificial Sequence
  synthetic polynucleotide
caugucgauagucuugcag

SEQ ID NO: 2587 - RNA, 13 nt, Artificial Sequence
  synthetic polynucleotide
accugcaagacua

SEQ ID NO: 2588 - RNA, 19 nt, Artificial Sequence
  synthetic polynucleotide
uagucuugcagguggauag

SEQ ID NO: 2589 - RNA, 13 nt, Artificial Sequence
  synthetic polynucleotide
gcuccacggagaa

SEQ ID NO: 2590 - RNA, 19 nt, Artificial Sequence
  synthetic polynucleotide
uucuccguggagcugaagc

SEQ ID NO: 2591 - RNA, 13 nt, Artificial Sequence
  synthetic polynucleotide
cacagcauauaua

SEQ ID NO: 2592 - RNA, 19 nt, Artificial Sequence
  synthetic polynucleotide
uauauaugcuguguguacu

SEQ ID NO: 2593 - RNA, 13 nt, Artificial Sequence
  synthetic polynucleotide
cagcauauauaua

SEQ ID NO: 2594 - RNA, 19 nt, Artificial Sequence
  synthetic polynucleotide
uauauauaugcugugugua

SEQ ID NO: 2595 - RNA, 13 nt, Artificial Sequence
  synthetic polynucleotide
guacauugacuua

SEQ ID NO: 2596 - RNA, 19 nt, Artificial Sequence
  synthetic polynucleotide
uaagucaauguacagcugc

SEQ ID NO: 2597 - RNA, 14 nt, Artificial Sequence
  synthetic polynucleotide
uguacauugacuua

SEQ ID NO: 2598 - RNA, 19 nt, Artificial Sequence
  synthetic polynucleotide
uaagucaauguacagcugc

SEQ ID NO: 2599 - RNA, 13 nt, Artificial Sequence
  synthetic polynucleotide
aacuauugcuuca

SEQ ID NO: 2600 - RNA, 19 nt, Artificial Sequence
  synthetic polynucleotide
ugaagcaauaguugguguc

SEQ ID NO: 2601 - RNA, 14 nt, Artificial Sequence
  synthetic polynucleotide
caacuauugcuuca

SEQ ID NO: 2602 - RNA, 19 nt, Artificial Sequence
  synthetic polynucleotide
ugaagcaauaguugguguc

SEQ ID NO: 2603 - RNA, 13 nt, Artificial Sequence
  synthetic polynucleotide
gcauauauaugua

SEQ ID NO: 2604 - RNA, 19 nt, Artificial Sequence
  synthetic polynucleotide
uacauauauaugcugugug

SEQ ID NO: 2605 - RNA, 13 nt, Artificial Sequence
  synthetic polynucleotide
uguacauugacua

SEQ ID NO: 2606 - RNA, 19 nt, Artificial Sequence
  synthetic polynucleotide
uagucaauguacagcugcc

SEQ ID NO: 2607 - RNA, 14 nt, Artificial Sequence
  synthetic polynucleotide
cuguacauugacua

SEQ ID NO: 2608 - RNA, 19 nt, Artificial Sequence
  synthetic polynucleotide
uagucaauguacagcugcc

SEQ ID NO: 2609 - RNA, 13 nt, Artificial Sequence
  synthetic polynucleotide
agcauauauauga

SEQ ID NO: 2610 - RNA, 19 nt, Artificial Sequence
  synthetic polynucleotide
ucauauauaugcugugugu

SEQ ID NO: 2611 - RNA, 13 nt, Artificial Sequence
  synthetic polynucleotide
cagcaacaauuca

SEQ ID NO: 2612 - RNA, 19 nt, Artificial Sequence
  synthetic polynucleotide
ugaauuguugcuguauuuc

SEQ ID NO: 2613 - RNA, 13 nt, Artificial Sequence
  synthetic polynucleotide
cauauauauguua

SEQ ID NO: 2614 - RNA, 19 nt, Artificial Sequence
  synthetic polynucleotide
uaacauauauaugcugugu

SEQ ID NO: 2615 - RNA, 13 nt, Artificial Sequence
  synthetic polynucleotide
uugcuucagcuca

SEQ ID NO: 2616 - RNA, 19 nt, Artificial Sequence
  synthetic polynucleotide
ugagcugaagcaauaguug

SEQ ID NO: 2617 - RNA, 14 nt, Artificial Sequence
  synthetic polynucleotide
auugcuucagcuca

SEQ ID NO: 2618 - RNA, 19 nt, Artificial Sequence
  synthetic polynucleotide
ugagcugaagcaauaguug

SEQ ID NO: 2619 - RNA, 13 nt, Artificial Sequence
  synthetic polynucleotide
acagcauauauaa

SEQ ID NO: 2620 - RNA, 19 nt, Artificial Sequence
  synthetic polynucleotide
uuauauaugcuguguguac

SEQ ID NO: 2621 - RNA, 13 nt, Artificial Sequence
  synthetic polynucleotide
auugcuucagcua

SEQ ID NO: 2622 - RNA, 19 nt, Artificial Sequence
  synthetic polynucleotide
uagcugaagcaauaguugg

SEQ ID NO: 2623 - RNA, 14 nt, Artificial Sequence
  synthetic polynucleotide
uauugcuucagcua

SEQ ID NO: 2624 - RNA, 19 nt, Artificial Sequence
  synthetic polynucleotide
uagcugaagcaauaguugg

SEQ ID NO: 2625 - RNA, 13 nt, Artificial Sequence
  synthetic polynucleotide
caaguucaagcaa

SEQ ID NO: 2626 - RNA, 19 nt, Artificial Sequence
  synthetic polynucleotide
uugcuugaacuugucauag

SEQ ID NO: 2627 - RNA, 13 nt, Artificial Sequence
  synthetic polynucleotide
cagaguacacaca

SEQ ID NO: 2628 - RNA, 19 nt, Artificial Sequence
  synthetic polynucleotide
uguguguacucugcuugaa

SEQ ID NO: 2629 - RNA, 13 nt, Artificial Sequence
  synthetic polynucleotide
acacacagcauaa

SEQ ID NO: 2630 - RNA, 19 nt, Artificial Sequence
  synthetic polynucleotide
uuaugcuguguguacucug

SEQ ID NO: 2631 - RNA, 13 nt, Artificial Sequence
  synthetic polynucleotide
cagcauauauaua

SEQ ID NO: 2632 - RNA, 19 nt, Artificial Sequence
  synthetic polynucleotide
uauauauaugcugugugua

SEQ ID NO: 2633 - RNA, 13 nt, Artificial Sequence
  synthetic polynucleotide
ucaagcagaguaa

SEQ ID NO: 2634 - RNA, 19 nt, Artificial Sequence
  synthetic polynucleotide
uuacucugcuugaacuugu

SEQ ID NO: 2635 - RNA, 13 nt, Artificial Sequence
  synthetic polynucleotide
agcauauauauga

SEQ ID NO: 2636 - RNA, 19 nt, Artificial Sequence
  synthetic polynucleotide
ucauauauaugcugugugu

SEQ ID NO: 2637 - RNA, 13 nt, Artificial Sequence
  synthetic polynucleotide
agaguacacacaa

SEQ ID NO: 2638 - RNA, 19 nt, Artificial Sequence
  synthetic polynucleotide
uuguguguacucugcuuga

SEQ ID NO: 2639 - RNA, 13 nt, Artificial Sequence
  synthetic polynucleotide
aagcagaguacaa

SEQ ID NO: 2640 - RNA, 19 nt, Artificial Sequence
  synthetic polynucleotide
uuguacucugcuugaacuu

SEQ ID NO: 2641 - RNA, 13 nt, Artificial Sequence
  synthetic polynucleotide
uucaacacaucaa

SEQ ID NO: 2642 - RNA, 19 nt, Artificial Sequence
  synthetic polynucleotide
uugauguguugaagaacau

SEQ ID NO: 2643 - RNA, 13 nt, Artificial Sequence
  synthetic polynucleotide
agcagaguacaca

SEQ ID NO: 2644 - RNA, 19 nt, Artificial Sequence
  synthetic polynucleotide
uguguacucugcuugaacu

SEQ ID NO: 2645 - RNA, 13 nt, Artificial Sequence
  synthetic polynucleotide
auauauguucuua

SEQ ID NO: 2646 - RNA, 19 nt, Artificial Sequence
  synthetic polynucleotide
uaagaacauauauaugcug

SEQ ID NO: 2647 - RNA, 13 nt, Artificial Sequence
  synthetic polynucleotide
gacaaguucaaga

SEQ ID NO: 2648 - RNA, 19 nt, Artificial Sequence
  synthetic polynucleotide
ucuugaacuugucauagau

SEQ ID NO: 2649 - RNA, 13 nt, Artificial Sequence
  synthetic polynucleotide
uuaaagauggaga

SEQ ID NO: 2650 - RNA, 19 nt, Artificial Sequence
  synthetic polynucleotide
ucuccaucuuuaauggggc

SEQ ID NO: 2651 - RNA, 13 nt, Artificial Sequence
  synthetic polynucleotide
cuaugacaaguua

SEQ ID NO: 2652 - RNA, 19 nt, Artificial Sequence
  synthetic polynucleotide
uaacuugucauagauuucg

SEQ ID NO: 2653 - RNA, 13 nt, Artificial Sequence
  synthetic polynucleotide
caacgaaaucuaa

SEQ ID NO: 2654 - RNA, 19 nt, Artificial Sequence
  synthetic polynucleotide
uuagauuucguuguggguu

SEQ ID NO: 2655 - RNA, 13 nt, Artificial Sequence
  synthetic polynucleotide
uaugacaaguuca

SEQ ID NO: 2656 - RNA, 19 nt, Artificial Sequence
  synthetic polynucleotide
ugaacuugucauagauuuc

SEQ ID NO: 2657 - RNA, 13 nt, Artificial Sequence
  synthetic polynucleotide
aaguucaagcaga

SEQ ID NO: 2658 - RNA, 19 nt, Artificial Sequence
  synthetic polynucleotide
ucugcuugaacuugucaua

SEQ ID NO: 2659 - RNA, 13 nt, Artificial Sequence
  synthetic polynucleotide
caagcagaguaca

SEQ ID NO: 2660 - RNA, 19 nt, Artificial Sequence
  synthetic polynucleotide
uguacucugcuugaacuug

SEQ ID NO: 2661 - RNA, 13 nt, Artificial Sequence
  synthetic polynucleotide
aaucuaugacaaa

SEQ ID NO: 2662 - RNA, 19 nt, Artificial Sequence
  synthetic polynucleotide
uuugucauagauuucguug

SEQ ID NO: 2663 - RNA, 13 nt, Artificial Sequence
  synthetic polynucleotide
cacacagcauaua

SEQ ID NO: 2664 - RNA, 19 nt, Artificial Sequence
  synthetic polynucleotide
uauaugcuguguguacucu

SEQ ID NO: 2665 - RNA, 13 nt, Artificial Sequence
  synthetic polynucleotide
cucaugaauuaga

SEQ ID NO: 2666 - RNA, 19 nt, Artificial Sequence
  synthetic polynucleotide
ucuaauucaugagaaauac

SEQ ID NO: 2667 - RNA, 13 nt, Artificial Sequence
  synthetic polynucleotide
cugaggucaauua

SEQ ID NO: 2668 - RNA, 19 nt, Artificial Sequence
  synthetic polynucleotide
uaauugaccucagaagaug

SEQ ID NO: 2669 - RNA, 13 nt, Artificial Sequence
  synthetic polynucleotide
gaggucaauuaaa

SEQ ID NO: 2670 - RNA, 19 nt, Artificial Sequence
  synthetic polynucleotide
uuuaauugaccucagaaga

SEQ ID NO: 2671 - RNA, 13 nt, Artificial Sequence
  synthetic polynucleotide
ucugaggucaauu

SEQ ID NO: 2672 - RNA, 19 nt, Artificial Sequence
  synthetic polynucleotide
aauugaccucagaagaugc

SEQ ID NO: 2673 - RNA, 13 nt, Artificial Sequence
  synthetic polynucleotide
ugaggucaauuaa

SEQ ID NO: 2674 - RNA, 19 nt, Artificial Sequence
  synthetic polynucleotide
uuaauugaccucagaagau

SEQ ID NO: 2675 - RNA, 13 nt, Artificial Sequence
  synthetic polynucleotide
uucugaggucaau

SEQ ID NO: 2676 - RNA, 19 nt, Artificial Sequence
  synthetic polynucleotide
auugaccucagaagaugca

SEQ ID NO: 2677 - RNA, 13 nt, Artificial Sequence
  synthetic polynucleotide
gucagcuggauga

SEQ ID NO: 2678 - RNA, 19 nt, Artificial Sequence
  synthetic polynucleotide
ucauccagcugacucguuu

SEQ ID NO: 2679 - RNA, 13 nt, Artificial Sequence
  synthetic polynucleotide
uucugaugaaucu

SEQ ID NO: 2680 - RNA, 19 nt, Artificial Sequence
  synthetic polynucleotide
agauucaucagaaugguga

SEQ ID NO: 2681 - RNA, 13 nt, Artificial Sequence
  synthetic polynucleotide
uggacugagguca

SEQ ID NO: 2682 - RNA, 19 nt, Artificial Sequence
  synthetic polynucleotide
ugaccucaguccauaaacc

SEQ ID NO: 2683 - RNA, 13 nt, Artificial Sequence
  synthetic polynucleotide
gagucucaccauu

SEQ ID NO: 2684 - RNA, 19 nt, Artificial Sequence
  synthetic polynucleotide
aauggugagacucaucaga

SEQ ID NO: 2685 - RNA, 13 nt, Artificial Sequence
  synthetic polynucleotide
gacugaggucaaa

SEQ ID NO: 2686 - RNA, 19 nt, Artificial Sequence
  synthetic polynucleotide
uuugaccucaguccauaaa

SEQ ID NO: 2687 - RNA, 13 nt, Artificial Sequence
  synthetic polynucleotide
ucacagccaugaa

SEQ ID NO: 2688 - RNA, 19 nt, Artificial Sequence
  synthetic polynucleotide
uucauggcugugaaauuca

SEQ ID NO: 2689 - RNA, 13 nt, Artificial Sequence
  synthetic polynucleotide
agucucaccauuc

SEQ ID NO: 2690 - RNA, 19 nt, Artificial Sequence
  synthetic polynucleotide
gaauggugagacucaucag

SEQ ID NO: 2691 - RNA, 13 nt, Artificial Sequence
  synthetic polynucleotide
aagcggaaagcca

SEQ ID NO: 2692 - RNA, 19 nt, Artificial Sequence
  synthetic polynucleotide
uggcuuuccgcuuauauaa

SEQ ID NO: 2693 - RNA, 13 nt, Artificial Sequence
  synthetic polynucleotide
agcggaaagccaa

SEQ ID NO: 2694 - RNA, 19 nt, Artificial Sequence
  synthetic polynucleotide
uuggcuuuccgcuuauaua

SEQ ID NO: 2695 - RNA, 13 nt, Artificial Sequence
  synthetic polynucleotide
accacauggauga

SEQ ID NO: 2696 - RNA, 19 nt, Artificial Sequence
  synthetic polynucleotide
ucauccauguggucauggc

SEQ ID NO: 2697 - RNA, 13 nt, Artificial Sequence
  synthetic polynucleotide
gccaugaccacau

SEQ ID NO: 2698 - RNA, 19 nt, Artificial Sequence
  synthetic polynucleotide
auguggucauggcuuucgu

SEQ ID NO: 2699 - RNA, 13 nt, Artificial Sequence
  synthetic polynucleotide
aagccaugaccac

SEQ ID NO: 2700 - RNA, 19 nt, Artificial Sequence
  synthetic polynucleotide
guggucauggcuuucguug

SEQ ID NO: 2701 - RNA, 13 nt, Artificial Sequence
  synthetic polynucleotide
gcggaaagccaau

SEQ ID NO: 2702 - RNA, 19 nt, Artificial Sequence
  synthetic polynucleotide
auuggcuuuccgcuuauau

SEQ ID NO: 2703 - RNA, 13 nt, Artificial Sequence
  synthetic polynucleotide
aaauuucguauuu

SEQ ID NO: 2704 - RNA, 19 nt, Artificial Sequence
  synthetic polynucleotide
aaauacgaaauuucaggug

SEQ ID NO: 2705 - RNA, 13 nt, Artificial Sequence
  synthetic polynucleotide
auuucguauuucu

SEQ ID NO: 2706 - RNA, 19 nt, Artificial Sequence
  synthetic polynucleotide
agaaauacgaaauuucagg

SEQ ID NO: 2707 - RNA, 13 nt, Artificial Sequence
  synthetic polynucleotide
aaagccaugacca

SEQ ID NO: 2708 - RNA, 19 nt, Artificial Sequence
  synthetic polynucleotide
uggucauggcuuucguugg

SEQ ID NO: 2709 - RNA, 13 nt, Artificial Sequence
  synthetic polynucleotide
acauggaugauau

SEQ ID NO: 2710 - RNA, 19 nt, Artificial Sequence
  synthetic polynucleotide
auaucauccauguggucau

SEQ ID NO: 2711 - RNA, 13 nt, Artificial Sequence
  synthetic polynucleotide
gaaauuucguauu

SEQ ID NO: 2712 - RNA, 19 nt, Artificial Sequence
  synthetic polynucleotide
aauacgaaauuucaggugu

SEQ ID NO: 2713 - RNA, 13 nt, Artificial Sequence
  synthetic polynucleotide
gcgccuucugauu

SEQ ID NO: 2714 - RNA, 19 nt, Artificial Sequence
  synthetic polynucleotide
aaucagaaggcgcguucag

SEQ ID NO: 2715 - RNA, 13 nt, Artificial Sequence
  synthetic polynucleotide
auuucucaugaau

SEQ ID NO: 2716 - RNA, 19 nt, Artificial Sequence
  synthetic polynucleotide
auucaugagaaauacgaaa

SEQ ID NO: 2717 - RNA, 13 nt, Artificial Sequence
  synthetic polynucleotide
cucucaugaauag

SEQ ID NO: 2718 - RNA, 19 nt, Artificial Sequence
  synthetic polynucleotide
cuauucaugagagaauaac

SEQ ID NO: 2719 - RNA, 13 nt, Artificial Sequence
  synthetic polynucleotide
aaguccaacgaaa

SEQ ID NO: 2720 - RNA, 19 nt, Artificial Sequence
  synthetic polynucleotide
uuucguuggacuuacuugg

SEQ ID NO: 2721 - RNA, 13 nt, Artificial Sequence
  synthetic polynucleotide
augaugagagcaa

SEQ ID NO: 2722 - RNA, 19 nt, Artificial Sequence
  synthetic polynucleotide
uugcucucaucauuggcuu

SEQ ID NO: 2723 - RNA, 13 nt, Artificial Sequence
  synthetic polynucleotide
gcgaggaguugaa

SEQ ID NO: 2724 - RNA, 19 nt, Artificial Sequence
  synthetic polynucleotide
uucaacuccucgcuuucca

SEQ ID NO: 2725 - RNA, 13 nt, Artificial Sequence
  synthetic polynucleotide
ugauugauaguca

SEQ ID NO: 2726 - RNA, 19 nt, Artificial Sequence
  synthetic polynucleotide
ugacuaucaaucacaucgg

SEQ ID NO: 2727 - RNA, 13 nt, Artificial Sequence
  synthetic polynucleotide
agauagugcaucu

SEQ ID NO: 2728 - RNA, 19 nt, Artificial Sequence
  synthetic polynucleotide
agaugcacuaucuaauuca

SEQ ID NO: 2729 - RNA, 13 nt, Artificial Sequence
  synthetic polynucleotide
auguguaucuauu

SEQ ID NO: 2730 - RNA, 19 nt, Artificial Sequence
  synthetic polynucleotide
aauagauacacauucaacc

SEQ ID NO: 2731 - RNA, 13 nt, Artificial Sequence
  synthetic polynucleotide
uucuauagaagaa

SEQ ID NO: 2732 - RNA, 19 nt, Artificial Sequence
  synthetic polynucleotide
uucuucuauagaaugaaca

SEQ ID NO: 2733 - RNA, 13 nt, Artificial Sequence
  synthetic polynucleotide
uuguccagcaauu

SEQ ID NO: 2734 - RNA, 19 nt, Artificial Sequence
  synthetic polynucleotide
aauugcuggacaaccgugg

SEQ ID NO: 2735 - RNA, 13 nt, Artificial Sequence
  synthetic polynucleotide
acauggaaagcga

SEQ ID NO: 2736 - RNA, 19 nt, Artificial Sequence
  synthetic polynucleotide
ucgcuuuccaugugugagg

SEQ ID NO: 2737 - RNA, 13 nt, Artificial Sequence
  synthetic polynucleotide
gcaguccagauua

SEQ ID NO: 2738 - RNA, 19 nt, Artificial Sequence
  synthetic polynucleotide
uaaucuggacugcuugugg

SEQ ID NO: 2739 - RNA, 13 nt, Artificial Sequence
  synthetic polynucleotide
ugguugaaugugu

SEQ ID NO: 2740 - RNA, 19 nt, Artificial Sequence
  synthetic polynucleotide
acacauucaaccaauaaac

SEQ ID NO: 2741 - RNA, 13 nt, Artificial Sequence
  synthetic polynucleotide
uuaugaaacgagu

SEQ ID NO: 2742 - RNA, 19 nt, Artificial Sequence
  synthetic polynucleotide
acucguuucauaacugucc

SEQ ID NO: 2743 - RNA, 13 nt, Artificial Sequence
  synthetic polynucleotide
caguccagauuau

SEQ ID NO: 2744 - RNA, 19 nt, Artificial Sequence
  synthetic polynucleotide
auaaucuggacugcuugug

SEQ ID NO: 2745 - RNA, 13 nt, Artificial Sequence
  synthetic polynucleotide
auauaagcggaaa

SEQ ID NO: 2746 - RNA, 19 nt, Artificial Sequence
  synthetic polynucleotide
uuuccgcuuauauaaucug

SEQ ID NO: 2747 - RNA, 13 nt, Artificial Sequence
  synthetic polynucleotide
uaccaguuaaaca

SEQ ID NO: 2748 - RNA, 19 nt, Artificial Sequence
  synthetic polynucleotide
uguuuaacugguauggcac

SEQ ID NO: 2749 - RNA, 13 nt, Artificial Sequence
  synthetic polynucleotide
uguucauucuaua

SEQ ID NO: 2750 - RNA, 19 nt, Artificial Sequence
  synthetic polynucleotide
uauagaaugaacauagaca

SEQ ID NO: 2751 - RNA, 13 nt, Artificial Sequence
  synthetic polynucleotide
ccgaccaaggaaa

SEQ ID NO: 2752 - RNA, 19 nt, Artificial Sequence
  synthetic polynucleotide
uuuccuuggucggcguuug

SEQ ID NO: 2753 - RNA, 13 nt, Artificial Sequence
  synthetic polynucleotide
gaauggugcauac

SEQ ID NO: 2754 - RNA, 19 nt, Artificial Sequence
  synthetic polynucleotide
guaugcaccauucaacucc

SEQ ID NO: 2755 - RNA, 13 nt, Artificial Sequence
  synthetic polynucleotide
auaugauggccga

SEQ ID NO: 2756 - RNA, 19 nt, Artificial Sequence
  synthetic polynucleotide
ucggccaucauaugugucu

SEQ ID NO: 2757 - RNA, 13 nt, Artificial Sequence
  synthetic polynucleotide
agcaguccagauu

SEQ ID NO: 2758 - RNA, 19 nt, Artificial Sequence
  synthetic polynucleotide
aaucuggacugcuuguggc

SEQ ID NO: 2759 - RNA, 13 nt, Artificial Sequence
  synthetic polynucleotide
gcauuuagucaaa

SEQ ID NO: 2760 - RNA, 19 nt, Artificial Sequence
  synthetic polynucleotide
uuugacuaaaugcaaagug

SEQ ID NO: 2761 - RNA, 13 nt, Artificial Sequence
  synthetic polynucleotide
agcauuccgaugu

SEQ ID NO: 2762 - RNA, 19 nt, Artificial Sequence
  synthetic polynucleotide
acaucggaaugcucauugc

SEQ ID NO: 2763 - RNA, 13 nt, Artificial Sequence
  synthetic polynucleotide
uagucaggaacuu

SEQ ID NO: 2764 - RNA, 19 nt, Artificial Sequence
  synthetic polynucleotide
aaguuccugacuaucaauc

SEQ ID NO: 2765 - RNA, 13 nt, Artificial Sequence
  synthetic polynucleotide
ugcauuuagucaa

SEQ ID NO: 2766 - RNA, 19 nt, Artificial Sequence
  synthetic polynucleotide
uugacuaaaugcaaaguga

SEQ ID NO: 2767 - RNA, 13 nt, Artificial Sequence
  synthetic polynucleotide
gucugaugagucu

SEQ ID NO: 2768 - RNA, 19 nt, Artificial Sequence
  synthetic polynucleotide
agacucaucagacugguga

SEQ ID NO: 2769 - RNA, 13 nt, Artificial Sequence
  synthetic polynucleotide
uagacacauauga

SEQ ID NO: 2770 - RNA, 19 nt, Artificial Sequence
  synthetic polynucleotide
ucauaugugucuacugugg

SEQ ID NO: 2771 - RNA, 13 nt, Artificial Sequence
  synthetic polynucleotide
cagacgaggacau

SEQ ID NO: 2772 - RNA, 19 nt, Artificial Sequence
  synthetic polynucleotide
auguccucgucuguagcau

SEQ ID NO: 2773 - RNA, 13 nt, Artificial Sequence
  synthetic polynucleotide
cagccgugaauuc

SEQ ID NO: 2774 - RNA, 19 nt, Artificial Sequence
  synthetic polynucleotide
gaauucacggcugacuuug

SEQ ID NO: 2775 - RNA, 13 nt, Artificial Sequence
  synthetic polynucleotide
agucuggaaauaa

SEQ ID NO: 2776 - RNA, 19 nt, Artificial Sequence
  synthetic polynucleotide
uuauuuccagacucaaaua

SEQ ID NO: 2777 - RNA, 13 nt, Artificial Sequence
  synthetic polynucleotide
aguuuguggcuuc

SEQ ID NO: 2778 - RNA, 19 nt, Artificial Sequence
  synthetic polynucleotide
gaagccacaaacuaaacua

SEQ ID NO: 2779 - RNA, 13 nt, Artificial Sequence
  synthetic polynucleotide
aguccaacgaaag

SEQ ID NO: 2780 - RNA, 19 nt, Artificial Sequence
  synthetic polynucleotide
cuuucguuggacuuacuug

SEQ ID NO: 2781 - RNA, 13 nt, Artificial Sequence
  synthetic polynucleotide
aaguuucgcagac

SEQ ID NO: 2782 - RNA, 19 nt, Artificial Sequence
  synthetic polynucleotide
gucugcgaaacuucuuaga

SEQ ID NO: 2783 - RNA, 13 nt, Artificial Sequence
  synthetic polynucleotide
agcaaugagcauu

SEQ ID NO: 2784 - RNA, 19 nt, Artificial Sequence
  synthetic polynucleotide
aaugcucauugcucucauc

SEQ ID NO: 2785 - RNA, 13 nt, Artificial Sequence
  synthetic polynucleotide
uuagauagugcau

SEQ ID NO: 2786 - RNA, 19 nt, Artificial Sequence
  synthetic polynucleotide
augcacuaucuaauucaug

SEQ ID NO: 2787 - RNA, 13 nt, Artificial Sequence
  synthetic polynucleotide
uggugcauacaag

SEQ ID NO: 2788 - RNA, 19 nt, Artificial Sequence
  synthetic polynucleotide
cuuguaugcaccauucaac

SEQ ID NO: 2789 - RNA, 13 nt, Artificial Sequence
  synthetic polynucleotide
augaaacgaguca

SEQ ID NO: 2790 - RNA, 19 nt, Artificial Sequence
  synthetic polynucleotide
ugacucguuucauaacugu

SEQ ID NO: 2791 - RNA, 13 nt, Artificial Sequence
  synthetic polynucleotide
ccagagugcugaa

SEQ ID NO: 2792 - RNA, 19 nt, Artificial Sequence
  synthetic polynucleotide
uucagcacucuggucaucc

SEQ ID NO: 2793 - RNA, 13 nt, Artificial Sequence
  synthetic polynucleotide
cagccaugaauuu

SEQ ID NO: 2794 - RNA, 19 nt, Artificial Sequence
  synthetic polynucleotide
aaauucauggcuguggaau

SEQ ID NO: 2795 - RNA, 13 nt, Artificial Sequence
  synthetic polynucleotide
auugguugaaugu

SEQ ID NO: 2796 - RNA, 19 nt, Artificial Sequence
  synthetic polynucleotide
acauucaaccaauaaacug

SEQ ID NO: 2797 - RNA, 13 nt, Artificial Sequence
  synthetic polynucleotide
gguugaaugugua

SEQ ID NO: 2798 - RNA, 19 nt, Artificial Sequence
  synthetic polynucleotide
uacacauucaaccaauaaa

SEQ ID NO: 2799 - RNA, 13 nt, Artificial Sequence
  synthetic polynucleotide
ggaaauaacuaau

SEQ ID NO: 2800 - RNA, 19 nt, Artificial Sequence
  synthetic polynucleotide
auuaguuauuuccagacuc

SEQ ID NO: 2801 - RNA, 13 nt, Artificial Sequence
  synthetic polynucleotide
ucaugaauagaaa

SEQ ID NO: 2802 - RNA, 19 nt, Artificial Sequence
  synthetic polynucleotide
uuucuauucaugagagaau

SEQ ID NO: 2803 - RNA, 13 nt, Artificial Sequence
  synthetic polynucleotide
gccagcaaccgaa

SEQ ID NO: 2804 - RNA, 19 nt, Artificial Sequence
  synthetic polynucleotide
uucgguugcuggcaggucc

SEQ ID NO: 2805 - RNA, 13 nt, Artificial Sequence
  synthetic polynucleotide
caccucacacaug

SEQ ID NO: 2806 - RNA, 19 nt, Artificial Sequence
  synthetic polynucleotide
caugugugaggugaugucc

SEQ ID NO: 2807 - RNA, 13 nt, Artificial Sequence
  synthetic polynucleotide
aguugaauggugc

SEQ ID NO: 2808 - RNA, 19 nt, Artificial Sequence
  synthetic polynucleotide
gcaccauucaacuccucgc

SEQ ID NO: 2809 - RNA, 13 nt, Artificial Sequence
  synthetic polynucleotide
agucagcuggaug

SEQ ID NO: 2810 - RNA, 19 nt, Artificial Sequence
  synthetic polynucleotide
cauccagcugacucguuuc

SEQ ID NO: 2811 - RNA, 13 nt, Artificial Sequence
  synthetic polynucleotide
uauaagcggaaag

SEQ ID NO: 2812 - RNA, 19 nt, Artificial Sequence
  synthetic polynucleotide
cuuuccgcuuauauaaucu

SEQ ID NO: 2813 - RNA, 13 nt, Artificial Sequence
  synthetic polynucleotide
uuccgaugugauu

SEQ ID NO: 2814 - RNA, 19 nt, Artificial Sequence
  synthetic polynucleotide
aaucacaucggaaugcuca

SEQ ID NO: 2815 - RNA, 13 nt, Artificial Sequence
  synthetic polynucleotide
auaacuaaugugu

SEQ ID NO: 2816 - RNA, 19 nt, Artificial Sequence
  synthetic polynucleotide
acacauuaguuauuuccag

SEQ ID NO: 2817 - RNA, 13 nt, Artificial Sequence
  synthetic polynucleotide
ucauucuauagaa

SEQ ID NO: 2818 - RNA, 19 nt, Artificial Sequence
  synthetic polynucleotide
uucuauagaaugaacauag

SEQ ID NO: 2819 - RNA, 13 nt, Artificial Sequence
  synthetic polynucleotide
aacuaucacugua

SEQ ID NO: 2820 - RNA, 19 nt, Artificial Sequence
  synthetic polynucleotide
uacagugauaguuugcauu

SEQ ID NO: 2821 - RNA, 13 nt, Artificial Sequence
  synthetic polynucleotide
gucaauugcuuau

SEQ ID NO: 2822 - RNA, 19 nt, Artificial Sequence
  synthetic polynucleotide
auaagcaauugacaccacc

SEQ ID NO: 2823 - RNA, 13 nt, Artificial Sequence
  synthetic polynucleotide
agcaauuaauaaa

SEQ ID NO: 2824 - RNA, 19 nt, Artificial Sequence
  synthetic polynucleotide
uuuauuaauugcuggacaa

SEQ ID NO: 2825 - RNA, 13 nt, Artificial Sequence
  synthetic polynucleotide
acgacucugauga

SEQ ID NO: 2826 - RNA, 19 nt, Artificial Sequence
  synthetic polynucleotide
ucaucagagucguucgagu

SEQ ID NO: 2827 - RNA, 13 nt, Artificial Sequence
  synthetic polynucleotide
uagugugguuuau

SEQ ID NO: 2828 - RNA, 19 nt, Artificial Sequence
  synthetic polynucleotide
auaaaccacacuaucaccu

SEQ ID NO: 2829 - RNA, 13 nt, Artificial Sequence
  synthetic polynucleotide
aagccaaugauga

SEQ ID NO: 2830 - RNA, 19 nt, Artificial Sequence
  synthetic polynucleotide
ucaucauuggcuuuccgcu

SEQ ID NO: 2831 - RNA, 13 nt, Artificial Sequence
  synthetic polynucleotide
auagucaggaacu

SEQ ID NO: 2832 - RNA, 19 nt, Artificial Sequence
  synthetic polynucleotide
aguuccugacuaucaauca

SEQ ID NO: 2833 - RNA, 13 nt, Artificial Sequence
  synthetic polynucleotide
agucagccgugaa

SEQ ID NO: 2834 - RNA, 19 nt, Artificial Sequence
  synthetic polynucleotide
uucacggcugacuuuggaa

SEQ ID NO: 2835 - RNA, 13 nt, Artificial Sequence
  synthetic polynucleotide
acuaccaugagaa

SEQ ID NO: 2836 - RNA, 19 nt, Artificial Sequence
  synthetic polynucleotide
uucucaugguagugaguuu

SEQ ID NO: 2837 - RNA, 13 nt, Artificial Sequence
  synthetic polynucleotide
aaacaggcugauu

SEQ ID NO: 2838 - RNA, 19 nt, Artificial Sequence
  synthetic polynucleotide
aaucagccuguuuaacugg

SEQ ID NO: 2839 - RNA, 13 nt, Artificial Sequence
  synthetic polynucleotide
gagugcugaaacc

SEQ ID NO: 2840 - RNA, 19 nt, Artificial Sequence
  synthetic polynucleotide
gguuucagcacucugguca

SEQ ID NO: 2841 - RNA, 13 nt, Artificial Sequence
  synthetic polynucleotide
ugagcauuccgau

SEQ ID NO: 2842 - RNA, 19 nt, Artificial Sequence
  synthetic polynucleotide
aucggaaugcucauugcuc

SEQ ID NO: 2843 - RNA, 13 nt, Artificial Sequence
  synthetic polynucleotide
aauuccacagcca

SEQ ID NO: 2844 - RNA, 19 nt, Artificial Sequence
  synthetic polynucleotide
uggcuguggaauucacggc

SEQ ID NO: 2845 - RNA, 13 nt, Artificial Sequence
  synthetic polynucleotide
ugucaauugcuua

SEQ ID NO: 2846 - RNA, 19 nt, Artificial Sequence
  synthetic polynucleotide
uaagcaauugacaccacca

SEQ ID NO: 2847 - RNA, 13 nt, Artificial Sequence
  synthetic polynucleotide
accaugagaauug

SEQ ID NO: 2848 - RNA, 19 nt, Artificial Sequence
  synthetic polynucleotide
caauucucaugguagugag

SEQ ID NO: 2849 - RNA, 13 nt, Artificial Sequence
  synthetic polynucleotide
ccaacgaaagcca

SEQ ID NO: 2850 - RNA, 19 nt, Artificial Sequence
  synthetic polynucleotide
uggcuuucguuggacuuac

SEQ ID NO: 2851 - RNA, 13 nt, Artificial Sequence
  synthetic polynucleotide
cuggucacugauu

SEQ ID NO: 2852 - RNA, 19 nt, Artificial Sequence
  synthetic polynucleotide
aaucagugaccaguucauc

SEQ ID NO: 2853 - RNA, 13 nt, Artificial Sequence
  synthetic polynucleotide
ugguuuauggacu

SEQ ID NO: 2854 - RNA, 19 nt, Artificial Sequence
  synthetic polynucleotide
aguccauaaaccacacuau

SEQ ID NO: 2855 - RNA, 13 nt, Artificial Sequence
  synthetic polynucleotide
gaccagagugcug

SEQ ID NO: 2856 - RNA, 19 nt, Artificial Sequence
  synthetic polynucleotide
cagcacucuggucauccag

SEQ ID NO: 2857 - RNA, 13 nt, Artificial Sequence
  synthetic polynucleotide
gaugugauugaua

SEQ ID NO: 2858 - RNA, 19 nt, Artificial Sequence
  synthetic polynucleotide
uaucaaucacaucggaaug

SEQ ID NO: 2859 - RNA, 13 nt, Artificial Sequence
  synthetic polynucleotide
gucagccgugaau

SEQ ID NO: 2860 - RNA, 19 nt, Artificial Sequence
  synthetic polynucleotide
auucacggcugacuuugga

SEQ ID NO: 2861 - RNA, 13 nt, Artificial Sequence
  synthetic polynucleotide
aauguguaucuau

SEQ ID NO: 2862 - RNA, 19 nt, Artificial Sequence
  synthetic polynucleotide
auagauacacauucaacca

SEQ ID NO: 2863 - RNA, 13 nt, Artificial Sequence
  synthetic polynucleotide
uugagucuggaaa

SEQ ID NO: 2864 - RNA, 19 nt, Artificial Sequence
  synthetic polynucleotide
uuuccagacucaaauagau

SEQ ID NO: 2865 - RNA, 13 nt, Artificial Sequence
  synthetic polynucleotide
guccagcaauuaa

SEQ ID NO: 2866 - RNA, 19 nt, Artificial Sequence
  synthetic polynucleotide
uuaauugcuggacaaccgu

SEQ ID NO: 2867 - RNA, 13 nt, Artificial Sequence
  synthetic polynucleotide
ccagcaauuaaua

SEQ ID NO: 2868 - RNA, 19 nt, Artificial Sequence
  synthetic polynucleotide
uauuaauugcuggacaacc

SEQ ID NO: 2869 - RNA, 13 nt, Artificial Sequence
  synthetic polynucleotide
gacucgaacgacu

SEQ ID NO: 2870 - RNA, 19 nt, Artificial Sequence
  synthetic polynucleotide
agucguucgagucaaugga

SEQ ID NO: 2871 - RNA, 13 nt, Artificial Sequence
  synthetic polynucleotide
accugccagcaac

SEQ ID NO: 2872 - RNA, 19 nt, Artificial Sequence
  synthetic polynucleotide
guugcuggcagguccgugg

SEQ ID NO: 2873 - RNA, 13 nt, Artificial Sequence
  synthetic polynucleotide
gaugaaucugaua

SEQ ID NO: 2874 - RNA, 19 nt, Artificial Sequence
  synthetic polynucleotide
uaucagauucaucagaaug

SEQ ID NO: 2875 - RNA, 14 nt, Artificial Sequence
  synthetic polynucleotide
ugaugaaucugaua

SEQ ID NO: 2876 - RNA, 19 nt, Artificial Sequence
  synthetic polynucleotide
uaucagauucaucagaaug

SEQ ID NO: 2877 - RNA, 13 nt, Artificial Sequence
  synthetic polynucleotide
auuugcuuuugca

SEQ ID NO: 2878 - RNA, 19 nt, Artificial Sequence
  synthetic polynucleotide
ugcaaaagcaaaucacugc

SEQ ID NO: 2879 - RNA, 14 nt, Artificial Sequence
  synthetic polynucleotide
gauuugcuuuugca

SEQ ID NO: 2880 - RNA, 19 nt, Artificial Sequence
  synthetic polynucleotide
ugcaaaagcaaaucacugc

SEQ ID NO: 2881 - RNA, 13 nt, Artificial Sequence
  synthetic polynucleotide
gugauuugcuuua

SEQ ID NO: 2882 - RNA, 19 nt, Artificial Sequence
  synthetic polynucleotide
uaaagcaaaucacugcaau

SEQ ID NO: 2883 - RNA, 14 nt, Artificial Sequence
  synthetic polynucleotide
agugauuugcuuua

SEQ ID NO: 2884 - RNA, 19 nt, Artificial Sequence
  synthetic polynucleotide
uaaagcaaaucacugcaau

SEQ ID NO: 2885 - RNA, 13 nt, Artificial Sequence
  synthetic polynucleotide
aauuucguauuua

SEQ ID NO: 2886 - RNA, 19 nt, Artificial Sequence
  synthetic polynucleotide
uaaauacgaaauuucaggu

SEQ ID NO: 2887 - RNA, 14 nt, Artificial Sequence
  synthetic polynucleotide
aaauuucguauuua

SEQ ID NO: 2888 - RNA, 19 nt, Artificial Sequence
  synthetic polynucleotide
uaaauacgaaauuucaggu

SEQ ID NO: 2889 - RNA, 13 nt, Artificial Sequence
  synthetic polynucleotide
cacagccaugaaa

SEQ ID NO: 2890 - RNA, 19 nt, Artificial Sequence
  synthetic polynucleotide
uuucauggcugugaaauuc

SEQ ID NO: 2891 - RNA, 14 nt, Artificial Sequence
  synthetic polynucleotide
ucacagccaugaaa

SEQ ID NO: 2892 - RNA, 19 nt, Artificial Sequence
  synthetic polynucleotide
uuucauggcugugaaauuc

SEQ ID NO: 2893 - RNA, 13 nt, Artificial Sequence
  synthetic polynucleotide
gauuugcuuuuga

SEQ ID NO: 2894 - RNA, 19 nt, Artificial Sequence
  synthetic polynucleotide
ucaaaagcaaaucacugca

SEQ ID NO: 2895 - RNA, 14 nt, Artificial Sequence
  synthetic polynucleotide
ugauuugcuuuuga

SEQ ID NO: 2896 - RNA, 19 nt, Artificial Sequence
  synthetic polynucleotide
ucaaaagcaaaucacugca

SEQ ID NO: 2897 - RNA, 13 nt, Artificial Sequence
  synthetic polynucleotide
uugcuuuugccua

SEQ ID NO: 2898 - RNA, 19 nt, Artificial Sequence
  synthetic polynucleotide
uaggcaaaagcaaaucacu

SEQ ID NO: 2899 - RNA, 14 nt, Artificial Sequence
  synthetic polynucleotide
uuugcuuuugccua

SEQ ID NO: 2900 - RNA, 19 nt, Artificial Sequence
  synthetic polynucleotide
uaggcaaaagcaaaucacu

SEQ ID NO: 2901 - RNA, 13 nt, Artificial Sequence
  synthetic polynucleotide
uuucucaguuuaa

SEQ ID NO: 2902 - RNA, 19 nt, Artificial Sequence
  synthetic polynucleotide
uuaaacugagaaagaagca

SEQ ID NO: 2903 - RNA, 13 nt, Artificial Sequence
  synthetic polynucleotide
uugcauuuaguca

SEQ ID NO: 2904 - RNA, 19 nt, Artificial Sequence
  synthetic polynucleotide
ugacuaaaugcaaagugag

SEQ ID NO: 2905 - RNA, 13 nt, Artificial Sequence
  synthetic polynucleotide
acuuugcauuuaa

SEQ ID NO: 2906 - RNA, 19 nt, Artificial Sequence
  synthetic polynucleotide
uuaaaugcaaagugagaaa

SEQ ID NO: 2907 - RNA, 13 nt, Artificial Sequence
  synthetic polynucleotide
auuuagucaaaaa

SEQ ID NO: 2908 - RNA, 19 nt, Artificial Sequence
  synthetic polynucleotide
uuuuugacuaaaugcaaag

SEQ ID NO: 2909 - RNA, 13 nt, Artificial Sequence
  synthetic polynucleotide
uucuuucucagua

SEQ ID NO: 2910 - RNA, 19 nt, Artificial Sequence
  synthetic polynucleotide
uacugagaaagaagcauuu

SEQ ID NO: 2911 - RNA, 13 nt, Artificial Sequence
  synthetic polynucleotide
ucuuucucaguua

SEQ ID NO: 2912 - RNA, 19 nt, Artificial Sequence
  synthetic polynucleotide
uaacugagaaagaagcauu

SEQ ID NO: 2913 - RNA, 13 nt, Artificial Sequence
  synthetic polynucleotide
gaaagagaacaua

SEQ ID NO: 2914 - RNA, 19 nt, Artificial Sequence
  synthetic polynucleotide
uauguucucuuucauuuug

SEQ ID NO: 2915 - RNA, 13 nt, Artificial Sequence
  synthetic polynucleotide
cuuugcauuuaga

SEQ ID NO: 2916 - RNA, 19 nt, Artificial Sequence
  synthetic polynucleotide
ucuaaaugcaaagugagaa

SEQ ID NO: 2917 - RNA, 13 nt, Artificial Sequence
  synthetic polynucleotide
uuugcauuuagua

SEQ ID NO: 2918 - RNA, 19 nt, Artificial Sequence
  synthetic polynucleotide
uacuaaaugcaaagugaga

SEQ ID NO: 2919 - RNA, 13 nt, Artificial Sequence
  synthetic polynucleotide
cucacuuugcaua

SEQ ID NO: 2920 - RNA, 19 nt, Artificial Sequence
  synthetic polynucleotide
uaugcaaagugagaaauug

SEQ ID NO: 2921 - RNA, 13 nt, Artificial Sequence
  synthetic polynucleotide
uucucacuuugca

SEQ ID NO: 2922 - RNA, 19 nt, Artificial Sequence
  synthetic polynucleotide
ugcaaagugagaaauugua

SEQ ID NO: 2923 - RNA, 13 nt, Artificial Sequence
  synthetic polynucleotide
cacuccaguugua

SEQ ID NO: 2924 - RNA, 19 nt, Artificial Sequence
  synthetic polynucleotide
uacaacuggagugaaaacu

SEQ ID NO: 2925 - RNA, 13 nt, Artificial Sequence
  synthetic polynucleotide
aaugaaagagaaa

SEQ ID NO: 2926 - RNA, 19 nt, Artificial Sequence
  synthetic polynucleotide
uuucucuuucauuuugcua

SEQ ID NO: 2927 - RNA, 13 nt, Artificial Sequence
  synthetic polynucleotide
ugcagugauuuga

SEQ ID NO: 2928 - RNA, 19 nt, Artificial Sequence
  synthetic polynucleotide
ucaaaucacugcaauucuc

SEQ ID NO: 2929 - RNA, 13 nt, Artificial Sequence
  synthetic polynucleotide
ugaaagagaacaa

SEQ ID NO: 2930 - RNA, 19 nt, Artificial Sequence
  synthetic polynucleotide
uuguucucuuucauuuugc

SEQ ID NO: 2931 - RNA, 13 nt, Artificial Sequence
  synthetic polynucleotide
accugaaauuuca

SEQ ID NO: 2932 - RNA, 19 nt, Artificial Sequence
  synthetic polynucleotide
ugaaauuucagguguuuau

SEQ ID NO: 2933 - RNA, 13 nt, Artificial Sequence
  synthetic polynucleotide
gaauugcagugaa

SEQ ID NO: 2934 - RNA, 19 nt, Artificial Sequence
  synthetic polynucleotide
uucacugcaauucucaugg

SEQ ID NO: 2935 - RNA, 13 nt, Artificial Sequence
  synthetic polynucleotide
ggcugauucugga

SEQ ID NO: 2936 - RNA, 19 nt, Artificial Sequence
  synthetic polynucleotide
uccagaaucagccuguuua

SEQ ID NO: 2937 - RNA, 14 nt, Artificial Sequence
  synthetic polynucleotide
agugauuugcuuua

SEQ ID NO: 2938 - RNA, 19 nt, Artificial Sequence
  synthetic polynucleotide
uaaagcaaaucacugcaau

SEQ ID NO: 2939 - RNA, 14 nt, Artificial Sequence
  synthetic polynucleotide
agugauuugcuuua

SEQ ID NO: 2940 - RNA, 19 nt, Artificial Sequence
  synthetic polynucleotide
uaaagcaaaucacugcaau

SEQ ID NO: 2941 - RNA, 14 nt, Artificial Sequence
  synthetic polynucleotide
agugauuugcuuua

SEQ ID NO: 2942 - RNA, 19 nt, Artificial Sequence
  synthetic polynucleotide
uaaagcaaaucacugcaau

SEQ ID NO: 2943 - RNA, 14 nt, Artificial Sequence
  synthetic polynucleotide
agugauuugcuuua

SEQ ID NO: 2944 - RNA, 19 nt, Artificial Sequence
  synthetic polynucleotide
uaaagcaaaucacugcaau

SEQ ID NO: 2945 - RNA, 13 nt, Artificial Sequence
  synthetic polynucleotide
cacauuugauuga

SEQ ID NO: 2946 - RNA, 19 nt, Artificial Sequence
  synthetic polynucleotide
ucaaucaaaugugaucugg

SEQ ID NO: 2947 - RNA, 13 nt, Artificial Sequence
  synthetic polynucleotide
cacugccucaauu

SEQ ID NO: 2948 - RNA, 19 nt, Artificial Sequence
  synthetic polynucleotide
aauugaggcaguguugaug

SEQ ID NO: 2949 - RNA, 13 nt, Artificial Sequence
  synthetic polynucleotide
aaauaccagucuu

SEQ ID NO: 2950 - RNA, 19 nt, Artificial Sequence
  synthetic polynucleotide
aagacugguauuucaucug

SEQ ID NO: 2951 - RNA, 13 nt, Artificial Sequence
  synthetic polynucleotide
cauuugauugaca

SEQ ID NO: 2952 - RNA, 19 nt, Artificial Sequence
  synthetic polynucleotide
ugucaaucaaaugugaucu

SEQ ID NO: 2953 - RNA, 13 nt, Artificial Sequence
  synthetic polynucleotide
gaaaacugcucaa

SEQ ID NO: 2954 - RNA, 19 nt, Artificial Sequence
  synthetic polynucleotide
uugagcaguuuucuccaua

SEQ ID NO: 2955 - RNA, 13 nt, Artificial Sequence
  synthetic polynucleotide
accucuccuauua

SEQ ID NO: 2956 - RNA, 19 nt, Artificial Sequence
  synthetic polynucleotide
uaauaggagagguuagaga

SEQ ID NO: 2957 - RNA, 13 nt, Artificial Sequence
  synthetic polynucleotide
uccaccaacuuaa

SEQ ID NO: 2958 - RNA, 19 nt, Artificial Sequence
  synthetic polynucleotide
uuaaguugguggacuguca

SEQ ID NO: 2959 - RNA, 14 nt, Artificial Sequence
  synthetic polynucleotide
guccaccaacuuaa

SEQ ID NO: 2960 - RNA, 19 nt, Artificial Sequence
  synthetic polynucleotide
uuaaguugguggacuguca

SEQ ID NO: 2961 - RNA, 13 nt, Artificial Sequence
  synthetic polynucleotide
cuccuauuauaca

SEQ ID NO: 2962 - RNA, 19 nt, Artificial Sequence
  synthetic polynucleotide
uguauaauaggagagguua

SEQ ID NO: 2963 - RNA, 13 nt, Artificial Sequence
  synthetic polynucleotide
gaucacauuugaa

SEQ ID NO: 2964 - RNA, 19 nt, Artificial Sequence
  synthetic polynucleotide
uucaaaugugaucuggaug

SEQ ID NO: 2965 - RNA, 14 nt, Artificial Sequence
  synthetic polynucleotide
agaucacauuugaa

SEQ ID NO: 2966 - RNA, 19 nt, Artificial Sequence
  synthetic polynucleotide
uucaaaugugaucuggaug

SEQ ID NO: 2967 - RNA, 13 nt, Artificial Sequence
  synthetic polynucleotide
aaccucuccuaua

SEQ ID NO: 2968 - RNA, 19 nt, Artificial Sequence
  synthetic polynucleotide
uauaggagagguuagagaa

SEQ ID NO: 2969 - RNA, 13 nt, Artificial Sequence
  synthetic polynucleotide
guugacauccaga

SEQ ID NO: 2970 - RNA, 19 nt, Artificial Sequence
  synthetic polynucleotide
ucuggaugucaacacauaa

SEQ ID NO: 2971 - RNA, 13 nt, Artificial Sequence
  synthetic polynucleotide
ccuuccuucgaaa

SEQ ID NO: 2972 - RNA, 19 nt, Artificial Sequence
  synthetic polynucleotide
uuucgaaggaagggaaugu

SEQ ID NO: 2973 - RNA, 13 nt, Artificial Sequence
  synthetic polynucleotide
acuccaaacacaa

SEQ ID NO: 2974 - RNA, 19 nt, Artificial Sequence
  synthetic polynucleotide
uuguguuuggaguggguuu

SEQ ID NO: 2975 - RNA, 14 nt, Artificial Sequence
  synthetic polynucleotide
cacuccaaacacaa

SEQ ID NO: 2976 - RNA, 19 nt, Artificial Sequence
  synthetic polynucleotide
uuguguuuggaguggguuu

SEQ ID NO: 2977 - RNA, 13 nt, Artificial Sequence
  synthetic polynucleotide
cacuccaaacaca

SEQ ID NO: 2978 - RNA, 19 nt, Artificial Sequence
  synthetic polynucleotide
uguguuuggaguggguuuc

SEQ ID NO: 2979 - RNA, 13 nt, Artificial Sequence
  synthetic polynucleotide
ccaccaacuuaca

SEQ ID NO: 2980 - RNA, 19 nt, Artificial Sequence
  synthetic polynucleotide
uguaaguugguggacuguc

SEQ ID NO: 2981 - RNA, 14 nt, Artificial Sequence
  synthetic polynucleotide
uccaccaacuuaca

SEQ ID NO: 2982 - RNA, 19 nt, Artificial Sequence
  synthetic polynucleotide
uguaaguugguggacuguc

SEQ ID NO: 2983 - RNA, 13 nt, Artificial Sequence
  synthetic polynucleotide
aauaccagucuua

SEQ ID NO: 2984 - RNA, 19 nt, Artificial Sequence
  synthetic polynucleotide
uaagacugguauuucaucu

SEQ ID NO: 2985 - RNA, 13 nt, Artificial Sequence
  synthetic polynucleotide
gaccaguauaaga

SEQ ID NO: 2986 - RNA, 19 nt, Artificial Sequence
  synthetic polynucleotide
ucuuauacuggucaaaucc

SEQ ID NO: 2987 - RNA, 13 nt, Artificial Sequence
  synthetic polynucleotide
gucuuuuaaugaa

SEQ ID NO: 2988 - RNA, 19 nt, Artificial Sequence
  synthetic polynucleotide
uucauuaaaagacugguau

SEQ ID NO: 2989 - RNA, 13 nt, Artificial Sequence
  synthetic polynucleotide
aauuucaugucua

SEQ ID NO: 2990 - RNA, 19 nt, Artificial Sequence
  synthetic polynucleotide
uagacaugaaauuacuggu

SEQ ID NO: 2991 - RNA, 13 nt, Artificial Sequence
  synthetic polynucleotide
aucacauuugaua

SEQ ID NO: 2992 - RNA, 19 nt, Artificial Sequence
  synthetic polynucleotide
uaucaaaugugaucuggau

SEQ ID NO: 2993 - RNA, 14 nt, Artificial Sequence
  synthetic polynucleotide
gaucacauuugaua

SEQ ID NO: 2994 - RNA, 19 nt, Artificial Sequence
  synthetic polynucleotide
uaucaaaugugaucuggau

SEQ ID NO: 2995 - RNA, 13 nt, Artificial Sequence
  synthetic polynucleotide
uccagaucacaua

SEQ ID NO: 2996 - RNA, 19 nt, Artificial Sequence
  synthetic polynucleotide
uaugugaucuggaugucaa

SEQ ID NO: 2997 - RNA, 13 nt, Artificial Sequence
  synthetic polynucleotide
uacugauaggaga

SEQ ID NO: 2998 - RNA, 19 nt, Artificial Sequence
  synthetic polynucleotide
ucuccuaucaguauuagcc

SEQ ID NO: 2999 - RNA, 13 nt, Artificial Sequence
  synthetic polynucleotide
gugcaacacuuga

SEQ ID NO: 3000 - RNA, 19 nt, Artificial Sequence
  synthetic polynucleotide
ucaaguguugcacauaauc

SEQ ID NO: 3001 - RNA, 13 nt, Artificial Sequence
  synthetic polynucleotide
accaguauaagua

SEQ ID NO: 3002 - RNA, 19 nt, Artificial Sequence
  synthetic polynucleotide
uacuuauacuggucaaauc

SEQ ID NO: 3003 - RNA, 13 nt, Artificial Sequence
  synthetic polynucleotide
gaagucuaaugaa

SEQ ID NO: 3004 - RNA, 19 nt, Artificial Sequence
  synthetic polynucleotide
uucauuagacuucuacagu

SEQ ID NO: 3005 - RNA, 13 nt, Artificial Sequence
  synthetic polynucleotide
aagaagaaaguua

SEQ ID NO: 3006 - RNA, 19 nt, Artificial Sequence
  synthetic polynucleotide
uaacuuucuucuuagaagc

SEQ ID NO: 3007 - RNA, 13 nt, Artificial Sequence
  synthetic polynucleotide
ucacauuugauua

SEQ ID NO: 3008 - RNA, 19 nt, Artificial Sequence
  synthetic polynucleotide
uaaucaaaugugaucugga

SEQ ID NO: 3009 - RNA, 14 nt, Artificial Sequence
  synthetic polynucleotide
aucacauuugauua

SEQ ID NO: 3010 - RNA, 19 nt, Artificial Sequence
  synthetic polynucleotide
uaaucaaaugugaucugga

SEQ ID NO: 3011 - RNA, 13 nt, Artificial Sequence
  synthetic polynucleotide
acauuugauugaa

SEQ ID NO: 3012 - RNA, 19 nt, Artificial Sequence
  synthetic polynucleotide
uucaaucaaaugugaucug

SEQ ID NO: 3013 - RNA, 14 nt, Artificial Sequence
  synthetic polynucleotide
cacauuugauugaa

SEQ ID NO: 3014 - RNA, 19 nt, Artificial Sequence
  synthetic polynucleotide
uucaaucaaaugugaucug

SEQ ID NO: 3015 - RNA, 13 nt, Artificial Sequence
  synthetic polynucleotide
auuugauugacaa

SEQ ID NO: 3016 - RNA, 19 nt, Artificial Sequence
  synthetic polynucleotide
uugucaaucaaaugugauc

SEQ ID NO: 3017 - RNA, 14 nt, Artificial Sequence
  synthetic polynucleotide
cauuugauugacaa

SEQ ID NO: 3018 - RNA, 19 nt, Artificial Sequence
  synthetic polynucleotide
uugucaaucaaaugugauc

SEQ ID NO: 3019 - RNA, 13 nt, Artificial Sequence
  synthetic polynucleotide
caucugcaauaaa

SEQ ID NO: 3020 - RNA, 19 nt, Artificial Sequence
  synthetic polynucleotide
uuuauugcagaugagagac

SEQ ID NO: 3021 - RNA, 14 nt, Artificial Sequence
  synthetic polynucleotide
ucaucugcaauaaa

SEQ ID NO: 3022 - RNA, 19 nt, Artificial Sequence
  synthetic polynucleotide
uuuauugcagaugagagac

SEQ ID NO: 3023 - RNA, 13 nt, Artificial Sequence
  synthetic polynucleotide
gaucacauuugaa

SEQ ID NO: 3024 - RNA, 19 nt, Artificial Sequence
  synthetic polynucleotide
uucaaaugugaucuggaug

SEQ ID NO: 3025 - RNA, 13 nt, Artificial Sequence
  synthetic polynucleotide
gaucacauuugaa

SEQ ID NO: 3026 - RNA, 19 nt, Artificial Sequence
  synthetic polynucleotide
uucaaaugugaucuggaug

SEQ ID NO: 3027 - RNA, 13 nt, Artificial Sequence
  synthetic polynucleotide
gaucacauuugaa

SEQ ID NO: 3028 - RNA, 19 nt, Artificial Sequence
  synthetic polynucleotide
uucaaaugugaucuggaug

SEQ ID NO: 3029 - RNA, 13 nt, Artificial Sequence
  synthetic polynucleotide
gaucacauuugaa

SEQ ID NO: 3030 - RNA, 19 nt, Artificial Sequence
  synthetic polynucleotide
uucaaaugugaucuggaug

SEQ ID NO: 3031 - RNA, 13 nt, Artificial Sequence
  synthetic polynucleotide
gaucacauuugaa

SEQ ID NO: 3032 - RNA, 19 nt, Artificial Sequence
  synthetic polynucleotide
uucaaaugugaucuggaug

SEQ ID NO: 3033 - RNA, 14 nt, Artificial Sequence
  synthetic polynucleotide
gaucacauuugaua

SEQ ID NO: 3034 - RNA, 20 nt, Artificial Sequence
  synthetic polynucleotide
uaucaaaugugaucuggaug

SEQ ID NO: 3035 - RNA, 14 nt, Artificial Sequence
  synthetic polynucleotide
gaucacauuugaua

SEQ ID NO: 3036 - RNA, 20 nt, Artificial Sequence
  synthetic polynucleotide
uaucaaaugugaucuggaug

SEQ ID NO: 3037 - RNA, 14 nt, Artificial Sequence
  synthetic polynucleotide
gaucacauuugaua

SEQ ID NO: 3038 - RNA, 20 nt, Artificial Sequence
  synthetic polynucleotide
uaucaaaugugaucuggaug

SEQ ID NO: 3039 - RNA, 14 nt, Artificial Sequence
  synthetic polynucleotide
gaucacauuugaua

SEQ ID NO: 3040 - RNA, 20 nt, Artificial Sequence
  synthetic polynucleotide
uaucaaaugugaucuggaug

SEQ ID NO: 3041 - RNA, 14 nt, Artificial Sequence
  synthetic polynucleotide
gaucacauuugaua

SEQ ID NO: 3042 - RNA, 20 nt, Artificial Sequence
  synthetic polynucleotide
uaucaaaugugaucuggaug

SEQ ID NO: 3043 - RNA, 14 nt, Artificial Sequence
  synthetic polynucleotide
gaucacauuugaua

SEQ ID NO: 3044 - RNA, 20 nt, Artificial Sequence
  synthetic polynucleotide
uaucaaaugugaucuggaug

SEQ ID NO: 3045 - RNA, 14 nt, Artificial Sequence
  synthetic polynucleotide
gaucacauuugaua

SEQ ID NO: 3046 - RNA, 20 nt, Artificial Sequence
  synthetic polynucleotide
uaucaaaugugaucuggaug

SEQ ID NO: 3047 - RNA, 14 nt, Artificial Sequence
  synthetic polynucleotide
gaucacauuugaua

SEQ ID NO: 3048 - RNA, 20 nt, Artificial Sequence
  synthetic polynucleotide
uaucaaaugugaucuggaug

SEQ ID NO: 3049 - RNA, 14 nt, Artificial Sequence
  synthetic polynucleotide
gaucacauuugaua

SEQ ID NO: 3050 - RNA, 19 nt, Artificial Sequence
  synthetic polynucleotide
uaucaaaugugaucuggau

SEQ ID NO: 3051 - RNA, 14 nt, Artificial Sequence
  synthetic polynucleotide
gaucacauuugaua

SEQ ID NO: 3052 - RNA, 19 nt, Artificial Sequence
  synthetic polynucleotide
uaucaaaugugaucuggau

SEQ ID NO: 3053 - RNA, 14 nt, Artificial Sequence
  synthetic polynucleotide
gaucacauuugaua

SEQ ID NO: 3054 - RNA, 19 nt, Artificial Sequence
  synthetic polynucleotide
uaucaaaugugaucuggau

SEQ ID NO: 3055 - RNA, 14 nt, Artificial Sequence
  synthetic polynucleotide
gaucacauuugaua

SEQ ID NO: 3056 - RNA, 19 nt, Artificial Sequence
  synthetic polynucleotide
uaucaaaugugaucuggau

SEQ ID NO: 3057 - RNA, 14 nt, Artificial Sequence
  synthetic polynucleotide
gaucacauuugaua

SEQ ID NO: 3058 - RNA, 19 nt, Artificial Sequence
  synthetic polynucleotide
uaucaaaugugaucuggau

SEQ ID NO: 3059 - RNA, 14 nt, Artificial Sequence
  synthetic polynucleotide
gaucacauuugaua

SEQ ID NO: 3060 - RNA, 19 nt, Artificial Sequence
  synthetic polynucleotide
uaucaaaugugaucuggau

SEQ ID NO: 3061 - RNA, 14 nt, Artificial Sequence
  synthetic polynucleotide
gaucacauuugaua

SEQ ID NO: 3062 - RNA, 19 nt, Artificial Sequence
  synthetic polynucleotide
uaucaaaugugaucuggau

SEQ ID NO: 3063 - RNA, 13 nt, Artificial Sequence
  synthetic polynucleotide
gaucacauuugaa

SEQ ID NO: 3064 - RNA, 19 nt, Artificial Sequence
  synthetic polynucleotide
uucaaaugugaucuggaug

SEQ ID NO: 3065 - RNA, 13 nt, Artificial Sequence
  synthetic polynucleotide
gaucacauuugaa

SEQ ID NO: 3066 - RNA, 19 nt, Artificial Sequence
  synthetic polynucleotide
uucaaaugugaucuggaug

SEQ ID NO: 3067 - RNA, 13 nt, Artificial Sequence
  synthetic polynucleotide
gaucacauuugaa

SEQ ID NO: 3068 - RNA, 19 nt, Artificial Sequence
  synthetic polynucleotide
uucaaaugugaucuggaug

SEQ ID NO: 3069 - RNA, 13 nt, Artificial Sequence
  synthetic polynucleotide
gaucacauuugaa

SEQ ID NO: 3070 - RNA, 19 nt, Artificial Sequence
  synthetic polynucleotide
uucaaaugugaucuggaug

SEQ ID NO: 3071 - RNA, 13 nt, Artificial Sequence
  synthetic polynucleotide
acaggaagaugua

SEQ ID NO: 3072 - RNA, 19 nt, Artificial Sequence
  synthetic polynucleotide
uacaucuuccuguaguaca

SEQ ID NO: 3073 - RNA, 13 nt, Artificial Sequence
  synthetic polynucleotide
gaguggagcgccu

SEQ ID NO: 3074 - RNA, 19 nt, Artificial Sequence
  synthetic polynucleotide
aggcgcuccacucuguggu

SEQ ID NO: 3075 - RNA, 13 nt, Artificial Sequence
  synthetic polynucleotide
cgacuggaagaca

SEQ ID NO: 3076 - RNA, 19 nt, Artificial Sequence
  synthetic polynucleotide
ugucuuccagucgguaagc

SEQ ID NO: 3077 - RNA, 13 nt, Artificial Sequence
  synthetic polynucleotide
ggagcgccuguuc

SEQ ID NO: 3078 - RNA, 19 nt, Artificial Sequence
  synthetic polynucleotide
gaacaggcgcuccacucug

SEQ ID NO: 3079 - RNA, 13 nt, Artificial Sequence
  synthetic polynucleotide
gccauuacaacug

SEQ ID NO: 3080 - RNA, 19 nt, Artificial Sequence
  synthetic polynucleotide
caguuguaauggcaggcac

SEQ ID NO: 3081 - RNA, 13 nt, Artificial Sequence
  synthetic polynucleotide
gagcuuucuggcu

SEQ ID NO: 3082 - RNA, 19 nt, Artificial Sequence
  synthetic polynucleotide
agccagaaagcucaaacuu

SEQ ID NO: 3083 - RNA, 13 nt, Artificial Sequence
  synthetic polynucleotide
aguggagcgccug

SEQ ID NO: 3084 - RNA, 19 nt, Artificial Sequence
  synthetic polynucleotide
caggcgcuccacucugugg

SEQ ID NO: 3085 - RNA, 13 nt, Artificial Sequence
  synthetic polynucleotide
uggagcgccuguu

SEQ ID NO: 3086 - RNA, 19 nt, Artificial Sequence
  synthetic polynucleotide
aacaggcgcuccacucugu

SEQ ID NO: 3087 - RNA, 13 nt, Artificial Sequence
  synthetic polynucleotide
guuugagcuuucu

SEQ ID NO: 3088 - RNA, 19 nt, Artificial Sequence
  synthetic polynucleotide
agaaagcucaaacuugaua

SEQ ID NO: 3089 - RNA, 13 nt, Artificial Sequence
  synthetic polynucleotide
ugccauuacaacu

SEQ ID NO: 3090 - RNA, 19 nt, Artificial Sequence
  synthetic polynucleotide
aguuguaauggcaggcaca

SEQ ID NO: 3091 - RNA, 13 nt, Artificial Sequence
  synthetic polynucleotide
acuggaagacacg

SEQ ID NO: 3092 - RNA, 19 nt, Artificial Sequence
  synthetic polynucleotide
cgugucuuccagucgguaa

SEQ ID NO: 3093 - RNA, 13 nt, Artificial Sequence
  synthetic polynucleotide
aacugccuggucc

SEQ ID NO: 3094 - RNA, 19 nt, Artificial Sequence
  synthetic polynucleotide
ggaccaggcaguuggcucu

SEQ ID NO: 3095 - RNA, 13 nt, Artificial Sequence
  synthetic polynucleotide
agaccugugccug

SEQ ID NO: 3096 - RNA, 19 nt, Artificial Sequence
  synthetic polynucleotide
caggcacaggucuugauga

SEQ ID NO: 3097 - RNA, 13 nt, Artificial Sequence
  synthetic polynucleotide
cagaguggagcgc

SEQ ID NO: 3098 - RNA, 19 nt, Artificial Sequence
  synthetic polynucleotide
gcgcuccacucuguggucu

SEQ ID NO: 3099 - RNA, 13 nt, Artificial Sequence
  synthetic polynucleotide
ccugguccagacc

SEQ ID NO: 3100 - RNA, 19 nt, Artificial Sequence
  synthetic polynucleotide
ggucuggaccaggcaguug

SEQ ID NO: 3101 - RNA, 13 nt, Artificial Sequence
  synthetic polynucleotide
ccauuacaacugu

SEQ ID NO: 3102 - RNA, 19 nt, Artificial Sequence
  synthetic polynucleotide
acaguuguaauggcaggca

SEQ ID NO: 3103 - RNA, 13 nt, Artificial Sequence
  synthetic polynucleotide
cugccauuacaac

SEQ ID NO: 3104 - RNA, 19 nt, Artificial Sequence
  synthetic polynucleotide
guuguaauggcaggcacag

SEQ ID NO: 3105 - RNA, 13 nt, Artificial Sequence
  synthetic polynucleotide
auuacaacugucc

SEQ ID NO: 3106 - RNA, 19 nt, Artificial Sequence
  synthetic polynucleotide
ggacaguuguaauggcagg

SEQ ID NO: 3107 - RNA, 13 nt, Artificial Sequence
  synthetic polynucleotide
cauuacaacuguc

SEQ ID NO: 3108 - RNA, 19 nt, Artificial Sequence
  synthetic polynucleotide
gacaguuguaauggcaggc

SEQ ID NO: 3109 - RNA, 13 nt, Artificial Sequence
  synthetic polynucleotide
agaguggagcgcc

SEQ ID NO: 3110 - RNA, 19 nt, Artificial Sequence
  synthetic polynucleotide
ggcgcuccacucugugguc

SEQ ID NO: 3111 - RNA, 13 nt, Artificial Sequence
  synthetic polynucleotide
accgacuggaaga

SEQ ID NO: 3112 - RNA, 19 nt, Artificial Sequence
  synthetic polynucleotide
ucuuccagucgguaagccg

SEQ ID NO: 3113 - RNA, 13 nt, Artificial Sequence
  synthetic polynucleotide
auguacggagaca

SEQ ID NO: 3114 - RNA, 19 nt, Artificial Sequence
  synthetic polynucleotide
ugucuccguacaucuuccu

SEQ ID NO: 3115 - RNA, 13 nt, Artificial Sequence
  synthetic polynucleotide
gccuugcgaagcu

SEQ ID NO: 3116 - RNA, 19 nt, Artificial Sequence
  synthetic polynucleotide
agcuucgcaaggccugacc

SEQ ID NO: 3117 - RNA, 13 nt, Artificial Sequence
  synthetic polynucleotide
gcugcgaggagug

SEQ ID NO: 3118 - RNA, 19 nt, Artificial Sequence
  synthetic polynucleotide
cacuccucgcagcauuucc

SEQ ID NO: 3119 - RNA, 13 nt, Artificial Sequence
  synthetic polynucleotide
gccuaucaaguuu

SEQ ID NO: 3120 - RNA, 19 nt, Artificial Sequence
  synthetic polynucleotide
aaacuugauaggcuuggag

SEQ ID NO: 3121 - RNA, 13 nt, Artificial Sequence
  synthetic polynucleotide
aauucuguggagu

SEQ ID NO: 3122 - RNA, 19 nt, Artificial Sequence
  synthetic polynucleotide
acuccacagaauuuagcuc

SEQ ID NO: 3123 - RNA, 13 nt, Artificial Sequence
  synthetic polynucleotide
uguacggagacau

SEQ ID NO: 3124 - RNA, 19 nt, Artificial Sequence
  synthetic polynucleotide
augucuccguacaucuucc

SEQ ID NO: 3125 - RNA, 13 nt, Artificial Sequence
  synthetic polynucleotide
agccuaucaaguu

SEQ ID NO: 3126 - RNA, 19 nt, Artificial Sequence
  synthetic polynucleotide
aacuugauaggcuuggaga

SEQ ID NO: 3127 - RNA, 13 nt, Artificial Sequence
  synthetic polynucleotide
caaguuugagcuu

SEQ ID NO: 3128 - RNA, 19 nt, Artificial Sequence
  synthetic polynucleotide
aagcucaaacuugauaggc

SEQ ID NO: 3129 - RNA, 13 nt, Artificial Sequence
  synthetic polynucleotide
cuguggaguaugu

SEQ ID NO: 3130 - RNA, 19 nt, Artificial Sequence
  synthetic polynucleotide
acauacuccacagaauuua

SEQ ID NO: 3131 - RNA, 13 nt, Artificial Sequence
  synthetic polynucleotide
aaauucuguggag

SEQ ID NO: 3132 - RNA, 19 nt, Artificial Sequence
  synthetic polynucleotide
cuccacagaauuuagcucg

SEQ ID NO: 3133 - RNA, 13 nt, Artificial Sequence
  synthetic polynucleotide
uuucaguagcaca

SEQ ID NO: 3134 - RNA, 19 nt, Artificial Sequence
  synthetic polynucleotide
ugugcuacugaaaucauuu

SEQ ID NO: 3135 - RNA, 13 nt, Artificial Sequence
  synthetic polynucleotide
caaugacaucuuu

SEQ ID NO: 3136 - RNA, 19 nt, Artificial Sequence
  synthetic polynucleotide
aaagaugucauugucuccg

SEQ ID NO: 3137 - RNA, 13 nt, Artificial Sequence
  synthetic polynucleotide
aguaccagugcac

SEQ ID NO: 3138 - RNA, 19 nt, Artificial Sequence
  synthetic polynucleotide
gugcacugguacuugcagc

SEQ ID NO: 3139 - RNA, 13 nt, Artificial Sequence
  synthetic polynucleotide
ggaagacacguuu

SEQ ID NO: 3140 - RNA, 19 nt, Artificial Sequence
  synthetic polynucleotide
aaacgugucuuccagucgg

SEQ ID NO: 3141 - RNA, 13 nt, Artificial Sequence
  synthetic polynucleotide
cuaucaaguuuga

SEQ ID NO: 3142 - RNA, 19 nt, Artificial Sequence
  synthetic polynucleotide
ucaaacuugauaggcuugg

SEQ ID NO: 3143 - RNA, 13 nt, Artificial Sequence
  synthetic polynucleotide
agcuaaauucugu

SEQ ID NO: 3144 - RNA, 19 nt, Artificial Sequence
  synthetic polynucleotide
acagaauuuagcucgguau

SEQ ID NO: 3145 - RNA, 13 nt, Artificial Sequence
  synthetic polynucleotide
agguagaauguaa

SEQ ID NO: 3146 - RNA, 19 nt, Artificial Sequence
  synthetic polynucleotide
uuacauucuaccuauggug

SEQ ID NO: 3147 - RNA, 13 nt, Artificial Sequence
  synthetic polynucleotide
agcugaucaguuu

SEQ ID NO: 3148 - RNA, 19 nt, Artificial Sequence
  synthetic polynucleotide
aaacugaucagcuauauag

SEQ ID NO: 3149 - RNA, 13 nt, Artificial Sequence
  synthetic polynucleotide
uucugcucagaua

SEQ ID NO: 3150 - RNA, 19 nt, Artificial Sequence
  synthetic polynucleotide
uaucugagcagaauuucca

SEQ ID NO: 3151 - RNA, 13 nt, Artificial Sequence
  synthetic polynucleotide
uuaucuaaguuaa

SEQ ID NO: 3152 - RNA, 19 nt, Artificial Sequence
  synthetic polynucleotide
uuaacuuagauaacuguac

SEQ ID NO: 3153 - RNA, 13 nt, Artificial Sequence
  synthetic polynucleotide
uauacgaguaaua

SEQ ID NO: 3154 - RNA, 19 nt, Artificial Sequence
  synthetic polynucleotide
uauuacucguauaagaugc

SEQ ID NO: 3155 - RNA, 13 nt, Artificial Sequence
  synthetic polynucleotide
gacuggacagcuu

SEQ ID NO: 3156 - RNA, 19 nt, Artificial Sequence
  synthetic polynucleotide
aagcuguccagucuaaucg

SEQ ID NO: 3157 - RNA, 13 nt, Artificial Sequence
  synthetic polynucleotide
auggccuuuauua

SEQ ID NO: 3158 - RNA, 19 nt, Artificial Sequence
  synthetic polynucleotide
uaauaaaggccauuuguuc

SEQ ID NO: 3159 - RNA, 13 nt, Artificial Sequence
  synthetic polynucleotide
auaccgagcuaaa

SEQ ID NO: 3160 - RNA, 19 nt, Artificial Sequence
  synthetic polynucleotide
uuuagcucgguaugucuuc

SEQ ID NO: 3161 - RNA, 13 nt, Artificial Sequence
  synthetic polynucleotide
uuguugagagugu

SEQ ID NO: 3162 - RNA, 19 nt, Artificial Sequence
  synthetic polynucleotide
acacucucaacaaauaaac

SEQ ID NO: 3163 - RNA, 13 nt, Artificial Sequence
  synthetic polynucleotide
acauaccgagcua

SEQ ID NO: 3164 - RNA, 19 nt, Artificial Sequence
  synthetic polynucleotide
uagcucgguaugucuucau

SEQ ID NO: 3165 - RNA, 13 nt, Artificial Sequence
  synthetic polynucleotide
agcagaaagguua

SEQ ID NO: 3166 - RNA, 19 nt, Artificial Sequence
  synthetic polynucleotide
uaaccuuucugcugguacc

SEQ ID NO: 3167 - RNA, 13 nt, Artificial Sequence
  synthetic polynucleotide
aguuguuccuuaa

SEQ ID NO: 3168 - RNA, 19 nt, Artificial Sequence
  synthetic polynucleotide
uuaaggaacaacuugacuc

SEQ ID NO: 3169 - RNA, 13 nt, Artificial Sequence
  synthetic polynucleotide
auuugaaguguaa

SEQ ID NO: 3170 - RNA, 19 nt, Artificial Sequence
  synthetic polynucleotide
uuacacuucaaauagcagg

SEQ ID NO: 3171 - RNA, 13 nt, Artificial Sequence
  synthetic polynucleotide
aagcugaccugga

SEQ ID NO: 3172 - RNA, 19 nt, Artificial Sequence
  synthetic polynucleotide
uccaggucagcuucgcaag

SEQ ID NO: 3173 - RNA, 13 nt, Artificial Sequence
  synthetic polynucleotide
ggucaugaagaag

SEQ ID NO: 3174 - RNA, 19 nt, Artificial Sequence
  synthetic polynucleotide
cuucuucaugaccucgccg

SEQ ID NO: 3175 - RNA, 13 nt, Artificial Sequence
  synthetic polynucleotide
auggucaggccuu

SEQ ID NO: 3176 - RNA, 19 nt, Artificial Sequence
  synthetic polynucleotide
aaggccugaccaugcacag

SEQ ID NO: 3177 - RNA, 13 nt, Artificial Sequence
  synthetic polynucleotide
gaagacacguuug

SEQ ID NO: 3178 - RNA, 19 nt, Artificial Sequence
  synthetic polynucleotide
caaacgugucuuccagucg

SEQ ID NO: 3179 - RNA, 13 nt, Artificial Sequence
  synthetic polynucleotide
aggccuugcgaag

SEQ ID NO: 3180 - RNA, 19 nt, Artificial Sequence
  synthetic polynucleotide
cuucgcaaggccugaccau

SEQ ID NO: 3181 - RNA, 13 nt, Artificial Sequence
  synthetic polynucleotide
uaccgacuggaag

SEQ ID NO: 3182 - RNA, 19 nt, Artificial Sequence
  synthetic polynucleotide
cuuccagucgguaagccgc

SEQ ID NO: 3183 - RNA, 13 nt, Artificial Sequence
  synthetic polynucleotide
accgcaagaucgg

SEQ ID NO: 3184 - RNA, 19 nt, Artificial Sequence
  synthetic polynucleotide
ccgaucuugcgguuggccg

SEQ ID NO: 3185 - RNA, 13 nt, Artificial Sequence
  synthetic polynucleotide
caggccuugcgaa

SEQ ID NO: 3186 - RNA, 19 nt, Artificial Sequence
  synthetic polynucleotide
uucgcaaggccugaccaug

SEQ ID NO: 3187 - RNA, 13 nt, Artificial Sequence
  synthetic polynucleotide
cgagcuaaauucu

SEQ ID NO: 3188 - RNA, 19 nt, Artificial Sequence
  synthetic polynucleotide
agaauuuagcucgguaugu

SEQ ID NO: 3189 - RNA, 13 nt, Artificial Sequence
  synthetic polynucleotide
ucuguggaguaug

SEQ ID NO: 3190 - RNA, 19 nt, Artificial Sequence
  synthetic polynucleotide
cauacuccacagaauuuag

SEQ ID NO: 3191 - RNA, 13 nt, Artificial Sequence
  synthetic polynucleotide
cggagacauggca

SEQ ID NO: 3192 - RNA, 19 nt, Artificial Sequence
  synthetic polynucleotide
ugccaugucuccguacauc

SEQ ID NO: 3193 - RNA, 13 nt, Artificial Sequence
  synthetic polynucleotide
augacaacgccuc

SEQ ID NO: 3194 - RNA, 19 nt, Artificial Sequence
  synthetic polynucleotide
gaggcguugucauugguaa

SEQ ID NO: 3195 - RNA, 13 nt, Artificial Sequence
  synthetic polynucleotide
gaggucaugaaga

SEQ ID NO: 3196 - RNA, 19 nt, Artificial Sequence
  synthetic polynucleotide
ucuucaugaccucgccguc

SEQ ID NO: 3197 - RNA, 13 nt, Artificial Sequence
  synthetic polynucleotide
uaaauucugugga

SEQ ID NO: 3198 - RNA, 19 nt, Artificial Sequence
  synthetic polynucleotide
uccacagaauuuagcucgg

SEQ ID NO: 3199 - RNA, 13 nt, Artificial Sequence
  synthetic polynucleotide
uggaagacacguu

SEQ ID NO: 3200 - RNA, 19 nt, Artificial Sequence
  synthetic polynucleotide
aacgugucuuccagucggu

SEQ ID NO: 3201 - RNA, 13 nt, Artificial Sequence
  synthetic polynucleotide
aagauguacggag

SEQ ID NO: 3202 - RNA, 19 nt, Artificial Sequence
  synthetic polynucleotide
cuccguacaucuuccugua

SEQ ID NO: 3203 - RNA, 13 nt, Artificial Sequence
  synthetic polynucleotide
aaugacaacgccu

SEQ ID NO: 3204 - RNA, 19 nt, Artificial Sequence
  synthetic polynucleotide
aggcguugucauugguaac

SEQ ID NO: 3205 - RNA, 13 nt, Artificial Sequence
  synthetic polynucleotide
ggcgaggucauga

SEQ ID NO: 3206 - RNA, 19 nt, Artificial Sequence
  synthetic polynucleotide
ucaugaccucgccgucagg

SEQ ID NO: 3207 - RNA, 13 nt, Artificial Sequence
  synthetic polynucleotide
gacacguuuggcc

SEQ ID NO: 3208 - RNA, 19 nt, Artificial Sequence
  synthetic polynucleotide
ggccaaacgugucuuccag

SEQ ID NO: 3209 - RNA, 13 nt, Artificial Sequence
  synthetic polynucleotide
acggagacauggc

SEQ ID NO: 3210 - RNA, 19 nt, Artificial Sequence
  synthetic polynucleotide
gccaugucuccguacaucu

SEQ ID NO: 3211 - RNA, 13 nt, Artificial Sequence
  synthetic polynucleotide
ucaggccuugcga

SEQ ID NO: 3212 - RNA, 19 nt, Artificial Sequence
  synthetic polynucleotide
ucgcaaggccugaccaugc

SEQ ID NO: 3213 - RNA, 13 nt, Artificial Sequence
  synthetic polynucleotide
gcgaagcugaccu

SEQ ID NO: 3214 - RNA, 19 nt, Artificial Sequence
  synthetic polynucleotide
aggucagcuucgcaaggcc

SEQ ID NO: 3215 - RNA, 13 nt, Artificial Sequence
  synthetic polynucleotide
ggaagauguacgg

SEQ ID NO: 3216 - RNA, 19 nt, Artificial Sequence
  synthetic polynucleotide
ccguacaucuuccuguagu

SEQ ID NO: 3217 - RNA, 13 nt, Artificial Sequence
  synthetic polynucleotide
gugacuucggcuc

SEQ ID NO: 3218 - RNA, 19 nt, Artificial Sequence
  synthetic polynucleotide
gagccgaagucacagaaga

SEQ ID NO: 3219 - RNA, 13 nt, Artificial Sequence
  synthetic polynucleotide
ugacuucggcucc

SEQ ID NO: 3220 - RNA, 19 nt, Artificial Sequence
  synthetic polynucleotide
ggagccgaagucacagaag

SEQ ID NO: 3221 - RNA, 13 nt, Artificial Sequence
  synthetic polynucleotide
uggucaggccuug

SEQ ID NO: 3222 - RNA, 19 nt, Artificial Sequence
  synthetic polynucleotide
caaggccugaccaugcaca

SEQ ID NO: 3223 - RNA, 13 nt, Artificial Sequence
  synthetic polynucleotide
ucaaguuugagcu

SEQ ID NO: 3224 - RNA, 19 nt, Artificial Sequence
  synthetic polynucleotide
agcucaaacuugauaggcu

SEQ ID NO: 3225 - RNA, 13 nt, Artificial Sequence
  synthetic polynucleotide
gccagaacugcag

SEQ ID NO: 3226 - RNA, 19 nt, Artificial Sequence
  synthetic polynucleotide
cugcaguucuggccgacgg

SEQ ID NO: 3227 - RNA, 13 nt, Artificial Sequence
  synthetic polynucleotide
uggaguauguacc

SEQ ID NO: 3228 - RNA, 19 nt, Artificial Sequence
  synthetic polynucleotide
gguacauacuccacagaau

SEQ ID NO: 3229 - RNA, 13 nt, Artificial Sequence
  synthetic polynucleotide
gcuagagaagcag

SEQ ID NO: 3230 - RNA, 19 nt, Artificial Sequence
  synthetic polynucleotide
cugcuucucuagccugcag

SEQ ID NO: 3231 - RNA, 13 nt, Artificial Sequence
  synthetic polynucleotide
ggucaggccuugc

SEQ ID NO: 3232 - RNA, 19 nt, Artificial Sequence
  synthetic polynucleotide
gcaaggccugaccaugcac

SEQ ID NO: 3233 - RNA, 13 nt, Artificial Sequence
  synthetic polynucleotide
gagcuaaauucug

SEQ ID NO: 3234 - RNA, 19 nt, Artificial Sequence
  synthetic polynucleotide
cagaauuuagcucgguaug

SEQ ID NO: 3235 - RNA, 13 nt, Artificial Sequence
  synthetic polynucleotide
aagacacguuugg

SEQ ID NO: 3236 - RNA, 19 nt, Artificial Sequence
  synthetic polynucleotide
ccaaacgugucuuccaguc

SEQ ID NO: 3237 - RNA, 13 nt, Artificial Sequence
  synthetic polynucleotide
cgaggucaugaag

SEQ ID NO: 3238 - RNA, 19 nt, Artificial Sequence
  synthetic polynucleotide
cuucaugaccucgccguca

SEQ ID NO: 3239 - RNA, 13 nt, Artificial Sequence
  synthetic polynucleotide
ggccuugcgaagc

SEQ ID NO: 3240 - RNA, 19 nt, Artificial Sequence
  synthetic polynucleotide
gcuucgcaaggccugacca

SEQ ID NO: 3241 - RNA, 13 nt, Artificial Sequence
  synthetic polynucleotide
cuugcgaagcuga

SEQ ID NO: 3242 - RNA, 19 nt, Artificial Sequence
  synthetic polynucleotide
ucagcuucgcaaggccuga

SEQ ID NO: 3243 - RNA, 13 nt, Artificial Sequence
  synthetic polynucleotide
ccgacuggaagac

SEQ ID NO: 3244 - RNA, 19 nt, Artificial Sequence
  synthetic polynucleotide
gucuuccagucgguaagcc

SEQ ID NO: 3245 - RNA, 13 nt, Artificial Sequence
  synthetic polynucleotide
ccuaucaaguuug

SEQ ID NO: 3246 - RNA, 19 nt, Artificial Sequence
  synthetic polynucleotide
caaacuugauaggcuugga

SEQ ID NO: 3247 - RNA, 13 nt, Artificial Sequence
  synthetic polynucleotide
uguuccaagaccu

SEQ ID NO: 3248 - RNA, 19 nt, Artificial Sequence
  synthetic polynucleotide
aggucuuggaacaggcgcu

SEQ ID NO: 3249 - RNA, 13 nt, Artificial Sequence
  synthetic polynucleotide
cgaagcugaccug

SEQ ID NO: 3250 - RNA, 19 nt, Artificial Sequence
  synthetic polynucleotide
caggucagcuucgcaaggc

SEQ ID NO: 3251 - RNA, 13 nt, Artificial Sequence
  synthetic polynucleotide
uugcgaagcugac

SEQ ID NO: 3252 - RNA, 19 nt, Artificial Sequence
  synthetic polynucleotide
gucagcuucgcaaggccug

SEQ ID NO: 3253 - RNA, 13 nt, Artificial Sequence
  synthetic polynucleotide
caaugacaacgcc

SEQ ID NO: 3254 - RNA, 19 nt, Artificial Sequence
  synthetic polynucleotide
ggcguugucauugguaacc

SEQ ID NO: 3255 - RNA, 13 nt, Artificial Sequence
  synthetic polynucleotide
guaccagugcacg

SEQ ID NO: 3256 - RNA, 19 nt, Artificial Sequence
  synthetic polynucleotide
cgugcacugguacuugcag

SEQ ID NO: 3257 - RNA, 13 nt, Artificial Sequence
  synthetic polynucleotide
ccuguuccaagac

SEQ ID NO: 3258 - RNA, 19 nt, Artificial Sequence
  synthetic polynucleotide
gucuuggaacaggcgcucc

SEQ ID NO: 3259 - RNA, 13 nt, Artificial Sequence
  synthetic polynucleotide
uacggagacaugg

SEQ ID NO: 3260 - RNA, 19 nt, Artificial Sequence
  synthetic polynucleotide
ccaugucuccguacaucuu

SEQ ID NO: 3261 - RNA, 13 nt, Artificial Sequence
  synthetic polynucleotide
ugcgaagcugacc

SEQ ID NO: 3262 - RNA, 19 nt, Artificial Sequence
  synthetic polynucleotide
ggucagcuucgcaaggccu

SEQ ID NO: 3263 - RNA, 13 nt, Artificial Sequence
  synthetic polynucleotide
ccuugcgaagcug

SEQ ID NO: 3264 - RNA, 19 nt, Artificial Sequence
  synthetic polynucleotide
cagcuucgcaaggccugac

SEQ ID NO: 3265 - RNA, 13 nt, Artificial Sequence
  synthetic polynucleotide
cugugacuucggc

SEQ ID NO: 3266 - RNA, 19 nt, Artificial Sequence
  synthetic polynucleotide
gccgaagucacagaagagg

SEQ ID NO: 3267 - RNA, 13 nt, Artificial Sequence
  synthetic polynucleotide
gcuaaauucugug

SEQ ID NO: 3268 - RNA, 19 nt, Artificial Sequence
  synthetic polynucleotide
cacagaauuuagcucggua

SEQ ID NO: 3269 - RNA, 13 nt, Artificial Sequence
  synthetic polynucleotide
cuaaauucugugg

SEQ ID NO: 3270 - RNA, 19 nt, Artificial Sequence
  synthetic polynucleotide
ccacagaauuuagcucggu

SEQ ID NO: 3271 - RNA, 13 nt, Artificial Sequence
  synthetic polynucleotide
agacacguuuggc

SEQ ID NO: 3272 - RNA, 19 nt, Artificial Sequence
  synthetic polynucleotide
gccaaacgugucuuccagu

SEQ ID NO: 3273 - RNA, 13 nt, Artificial Sequence
  synthetic polynucleotide
ccgcaagaucggc

SEQ ID NO: 3274 - RNA, 19 nt, Artificial Sequence
  synthetic polynucleotide
gccgaucuugcgguuggcc

SEQ ID NO: 3275 - RNA, 13 nt, Artificial Sequence
  synthetic polynucleotide
uaucaaguuugag

SEQ ID NO: 3276 - RNA, 19 nt, Artificial Sequence
  synthetic polynucleotide
cucaaacuugauaggcuug

SEQ ID NO: 3277 - RNA, 13 nt, Artificial Sequence
  synthetic polynucleotide
gaagcugaccugg

SEQ ID NO: 3278 - RNA, 19 nt, Artificial Sequence
  synthetic polynucleotide
ccaggucagcuucgcaagg

SEQ ID NO: 3279 - RNA, 13 nt, Artificial Sequence
  synthetic polynucleotide
acauuaacucaua

SEQ ID NO: 3280 - RNA, 19 nt, Artificial Sequence
  synthetic polynucleotide
uaugaguuaaugucucuca

SEQ ID NO: 3281 - RNA, 14 nt, Artificial Sequence
  synthetic polynucleotide
gacauuaacucaua

SEQ ID NO: 3282 - RNA, 19 nt, Artificial Sequence
  synthetic polynucleotide
uaugaguuaaugucucuca

SEQ ID NO: 3283 - RNA, 13 nt, Artificial Sequence
  synthetic polynucleotide
ugaagaauguuaa

SEQ ID NO: 3284 - RNA, 19 nt, Artificial Sequence
  synthetic polynucleotide
uuaacauucuucaaaccag

SEQ ID NO: 3285 - RNA, 14 nt, Artificial Sequence
  synthetic polynucleotide
uugaagaauguuaa

SEQ ID NO: 3286 - RNA, 19 nt, Artificial Sequence
  synthetic polynucleotide
uuaacauucuucaaaccag

SEQ ID NO: 3287 - RNA, 13 nt, Artificial Sequence
  synthetic polynucleotide
gauagcaucuuaa

SEQ ID NO: 3288 - RNA, 19 nt, Artificial Sequence
  synthetic polynucleotide
uuaagaugcuaucugauga

SEQ ID NO: 3289 - RNA, 14 nt, Artificial Sequence
  synthetic polynucleotide
agauagcaucuuaa

SEQ ID NO: 3290 - RNA, 19 nt, Artificial Sequence
  synthetic polynucleotide
uuaagaugcuaucugauga

SEQ ID NO: 3291 - RNA, 13 nt, Artificial Sequence
  synthetic polynucleotide
ugaaguguaauua

SEQ ID NO: 3292 - RNA, 19 nt, Artificial Sequence
  synthetic polynucleotide
uaauuacacuucaaauagc

SEQ ID NO: 3293 - RNA, 13 nt, Artificial Sequence
  synthetic polynucleotide
aauugagaaggaa

SEQ ID NO: 3294 - RNA, 19 nt, Artificial Sequence
  synthetic polynucleotide
uuccuucucaauuacacuu

SEQ ID NO: 3295 - RNA, 13 nt, Artificial Sequence
  synthetic polynucleotide
uugagaaggaaaa

SEQ ID NO: 3296 - RNA, 19 nt, Artificial Sequence
  synthetic polynucleotide
uuuuccuucucaauuacac

SEQ ID NO: 3297 - RNA, 13 nt, Artificial Sequence
  synthetic polynucleotide
cauucugauucga

SEQ ID NO: 3298 - RNA, 19 nt, Artificial Sequence
  synthetic polynucleotide
ucgaaucagaaugucagag

SEQ ID NO: 3299 - RNA, 13 nt, Artificial Sequence
  synthetic polynucleotide
uucugauucgaaa

SEQ ID NO: 3300 - RNA, 19 nt, Artificial Sequence
  synthetic polynucleotide
uuucgaaucagaaugucag

SEQ ID NO: 3301 - RNA, 13 nt, Artificial Sequence
  synthetic polynucleotide
cugucgauuagaa

SEQ ID NO: 3302 - RNA, 19 nt, Artificial Sequence
  synthetic polynucleotide
uucuaaucgacaggauucc

SEQ ID NO: 3303 - RNA, 13 nt, Artificial Sequence
  synthetic polynucleotide
uuugccuguaaca

SEQ ID NO: 3304 - RNA, 19 nt, Artificial Sequence
  synthetic polynucleotide
uguuacaggcaaauucacu

SEQ ID NO: 3305 - RNA, 14 nt, Artificial Sequence
  synthetic polynucleotide
auuugccuguaaca

SEQ ID NO: 3306 - RNA, 19 nt, Artificial Sequence
  synthetic polynucleotide
uguuacaggcaaauucacu

SEQ ID NO: 3307 - RNA, 13 nt, Artificial Sequence
  synthetic polynucleotide
acaagccagauua

SEQ ID NO: 3308 - RNA, 19 nt, Artificial Sequence
  synthetic polynucleotide
uaaucuggcuuguuacagg

SEQ ID NO: 3309 - RNA, 14 nt, Artificial Sequence
  synthetic polynucleotide
aacaagccagauua

SEQ ID NO: 3310 - RNA, 19 nt, Artificial Sequence
  synthetic polynucleotide
uaaucuggcuuguuacagg

SEQ ID NO: 3311 - RNA, 13 nt, Artificial Sequence
  synthetic polynucleotide
caguuuauuugua

SEQ ID NO: 3312 - RNA, 19 nt, Artificial Sequence
  synthetic polynucleotide
uacaaauaaacuguccgaa

SEQ ID NO: 3313 - RNA, 13 nt, Artificial Sequence
  synthetic polynucleotide
uguugagagugua

SEQ ID NO: 3314 - RNA, 19 nt, Artificial Sequence
  synthetic polynucleotide
uacacucucaacaaauaaa

SEQ ID NO: 3315 - RNA, 14 nt, Artificial Sequence
  synthetic polynucleotide
uuguugagagugua

SEQ ID NO: 3316 - RNA, 19 nt, Artificial Sequence
  synthetic polynucleotide
uacacucucaacaaauaaa

SEQ ID NO: 3317 - RNA, 13 nt, Artificial Sequence
  synthetic polynucleotide
ugcaccuuucuaa

SEQ ID NO: 3318 - RNA, 19 nt, Artificial Sequence
  synthetic polynucleotide
uuagaaaggugcaaacaug

SEQ ID NO: 3319 - RNA, 14 nt, Artificial Sequence
  synthetic polynucleotide
uugcaccuuucuaa

SEQ ID NO: 3320 - RNA, 19 nt, Artificial Sequence
  synthetic polynucleotide
uuagaaaggugcaaacaug

SEQ ID NO: 3321 - RNA, 13 nt, Artificial Sequence
  synthetic polynucleotide
uugagcuuucuga

SEQ ID NO: 3322 - RNA, 19 nt, Artificial Sequence
  synthetic polynucleotide
ucagaaagcucaaacuuga

SEQ ID NO: 3323 - RNA, 13 nt, Artificial Sequence
  synthetic polynucleotide
ugagagugugaca

SEQ ID NO: 3324 - RNA, 19 nt, Artificial Sequence
  synthetic polynucleotide
ugucacacucucaacaaau

SEQ ID NO: 3325 - RNA, 13 nt, Artificial Sequence
  synthetic polynucleotide
agugugaccaaaa

SEQ ID NO: 3326 - RNA, 19 nt, Artificial Sequence
  synthetic polynucleotide
uuuuggucacacucucaac

SEQ ID NO: 3327 - RNA, 14 nt, Artificial Sequence
  synthetic polynucleotide
gagugugaccaaaa

SEQ ID NO: 3328 - RNA, 19 nt, Artificial Sequence
  synthetic polynucleotide
uuuuggucacacucucaac

SEQ ID NO: 3329 - RNA, 13 nt, Artificial Sequence
  synthetic polynucleotide
gugugaccaaaaa

SEQ ID NO: 3330 - RNA, 19 nt, Artificial Sequence
  synthetic polynucleotide
uuuuuggucacacucucaa

SEQ ID NO: 3331 - RNA, 13 nt, Artificial Sequence
  synthetic polynucleotide
ugugaccaaaaga

SEQ ID NO: 3332 - RNA, 19 nt, Artificial Sequence
  synthetic polynucleotide
ucuuuuggucacacucuca

SEQ ID NO: 3333 - RNA, 14 nt, Artificial Sequence
  synthetic polynucleotide
gugugaccaaaaga

SEQ ID NO: 3334 - RNA, 19 nt, Artificial Sequence
  synthetic polynucleotide
ucuuuuggucacacucuca

SEQ ID NO: 3335 - RNA, 13 nt, Artificial Sequence
  synthetic polynucleotide
gugaccaaaagua

SEQ ID NO: 3336 - RNA, 19 nt, Artificial Sequence
  synthetic polynucleotide
uacuuuuggucacacucuc

SEQ ID NO: 3337 - RNA, 13 nt, Artificial Sequence
  synthetic polynucleotide
gaccaaaaguuaa

SEQ ID NO: 3338 - RNA, 19 nt, Artificial Sequence
  synthetic polynucleotide
uuaacuuuuggucacacuc

SEQ ID NO: 3339 - RNA, 13 nt, Artificial Sequence
  synthetic polynucleotide
gcaccuuucuaga

SEQ ID NO: 3340 - RNA, 19 nt, Artificial Sequence
  synthetic polynucleotide
ucuagaaaggugcaaacau

SEQ ID NO: 3341 - RNA, 13 nt, Artificial Sequence
  synthetic polynucleotide
ccuuucuaguuga

SEQ ID NO: 3342 - RNA, 19 nt, Artificial Sequence
  synthetic polynucleotide
ucaacuagaaaggugcaaa

SEQ ID NO: 3343 - RNA, 13 nt, Artificial Sequence
  synthetic polynucleotide
gcaccuuucuaga

SEQ ID NO: 3344 - RNA, 19 nt, Artificial Sequence
  synthetic polynucleotide
ucuagaaaggugcaaacau

SEQ ID NO: 3345 - RNA, 13 nt, Artificial Sequence
  synthetic polynucleotide
gcaccuuucuaga

SEQ ID NO: 3346 - RNA, 19 nt, Artificial Sequence
  synthetic polynucleotide
ucuagaaaggugcaaacau

SEQ ID NO: 3347 - RNA, 13 nt, Artificial Sequence
  synthetic polynucleotide
gcaccuuucuaga

SEQ ID NO: 3348 - RNA, 19 nt, Artificial Sequence
  synthetic polynucleotide
ucuagaaaggugcaaacau

SEQ ID NO: 3349 - RNA, 13 nt, Artificial Sequence
  synthetic polynucleotide
gcaccuuucuaga

SEQ ID NO: 3350 - RNA, 19 nt, Artificial Sequence
  synthetic polynucleotide
ucuagaaaggugcaaacau

SEQ ID NO: 3351 - RNA, 13 nt, Artificial Sequence
  synthetic polynucleotide
gcaccuuucuaga

SEQ ID NO: 3352 - RNA, 19 nt, Artificial Sequence
  synthetic polynucleotide
ucuagaaaggugcaaacau

SEQ ID NO: 3353 - RNA, 13 nt, Artificial Sequence
  synthetic polynucleotide
gcaccuuucuaga

SEQ ID NO: 3354 - RNA, 19 nt, Artificial Sequence
  synthetic polynucleotide
ucuagaaaggugcaaacau

SEQ ID NO: 3355 - RNA, 13 nt, Artificial Sequence
  synthetic polynucleotide
gcaccuuucuaga

SEQ ID NO: 3356 - RNA, 19 nt, Artificial Sequence
  synthetic polynucleotide
ucuagaaaggugcaaacau

SEQ ID NO: 3357 - RNA, 13 nt, Artificial Sequence
  synthetic polynucleotide
gcaccuuucuaga

SEQ ID NO: 3358 - RNA, 19 nt, Artificial Sequence
  synthetic polynucleotide
ucuagaaaggugcaaacau

SEQ ID NO: 3359 - RNA, 13 nt, Artificial Sequence
  synthetic polynucleotide
gcaccuuucuaga

SEQ ID NO: 3360 - RNA, 19 nt, Artificial Sequence
  synthetic polynucleotide
ucuagaaaggugcaaacau

SEQ ID NO: 3361 - RNA, 13 nt, Artificial Sequence
  synthetic polynucleotide
gcaccuuucuaga

SEQ ID NO: 3362 - RNA, 19 nt, Artificial Sequence
  synthetic polynucleotide
ucuagaaaggugcaaacau

SEQ ID NO: 3363 - RNA, 13 nt, Artificial Sequence
  synthetic polynucleotide
gcaccuuucuaga

SEQ ID NO: 3364 - RNA, 19 nt, Artificial Sequence
  synthetic polynucleotide
ucuagaaaggugcaaacau

SEQ ID NO: 3365 - RNA, 13 nt, Artificial Sequence
  synthetic polynucleotide
gugaccaaaagua

SEQ ID NO: 3366 - RNA, 19 nt, Artificial Sequence
  synthetic polynucleotide
uacuuuuggucacacucuc

SEQ ID NO: 3367 - RNA, 13 nt, Artificial Sequence
  synthetic polynucleotide
gugaccaaaagua

SEQ ID NO: 3368 - RNA, 19 nt, Artificial Sequence
  synthetic polynucleotide
uacuuuuggucacacucuc

SEQ ID NO: 3369 - RNA, 13 nt, Artificial Sequence
  synthetic polynucleotide
gugaccaaaagua

SEQ ID NO: 3370 - RNA, 19 nt, Artificial Sequence
  synthetic polynucleotide
uacuuuuggucacacucuc

SEQ ID NO: 3371 - RNA, 14 nt, Artificial Sequence
  synthetic polynucleotide
uugcaccuuucuaa

SEQ ID NO: 3372 - RNA, 20 nt, Artificial Sequence
  synthetic polynucleotide
uuagaaaggugcaaacaagg

SEQ ID NO: 3373 - RNA, 14 nt, Artificial Sequence
  synthetic polynucleotide
uugcaccuuucuaa

SEQ ID NO: 3374 - RNA, 20 nt, Artificial Sequence
  synthetic polynucleotide
uuagaaaggugcaaacaagg

SEQ ID NO: 3375 - RNA, 14 nt, Artificial Sequence
  synthetic polynucleotide
uugcaccuuucuaa

SEQ ID NO: 3376 - RNA, 20 nt, Artificial Sequence
  synthetic polynucleotide
uuagaaaggugcaaacaagg

SEQ ID NO: 3377 - RNA, 14 nt, Artificial Sequence
  synthetic polynucleotide
uugcaccuuucuaa

SEQ ID NO: 3378 - RNA, 20 nt, Artificial Sequence
  synthetic polynucleotide
uuagaaaggugcaaacaagg

SEQ ID NO: 3379 - RNA, 14 nt, Artificial Sequence
  synthetic polynucleotide
uugcaccuuucuaa

SEQ ID NO: 3380 - RNA, 20 nt, Artificial Sequence
  synthetic polynucleotide
uuagaaaggugcaaacaagg

SEQ ID NO: 3381 - RNA, 14 nt, Artificial Sequence
  synthetic polynucleotide
uugcaccuuucuaa

SEQ ID NO: 3382 - RNA, 20 nt, Artificial Sequence
  synthetic polynucleotide
uuagaaaggugcaaacaagg

SEQ ID NO: 3383 - RNA, 14 nt, Artificial Sequence
  synthetic polynucleotide
uugcaccuuucuaa

SEQ ID NO: 3384 - RNA, 20 nt, Artificial Sequence
  synthetic polynucleotide
uuagaaaggugcaaacaagg

SEQ ID NO: 3385 - RNA, 14 nt, Artificial Sequence
  synthetic polynucleotide
uugcaccuuucuaa

SEQ ID NO: 3386 - RNA, 20 nt, Artificial Sequence
  synthetic polynucleotide
uuagaaaggugcaaacaagg

SEQ ID NO: 3387 - RNA, 14 nt, Artificial Sequence
  synthetic polynucleotide
uugcaccuuucuaa

SEQ ID NO: 3388 - RNA, 20 nt, Artificial Sequence
  synthetic polynucleotide
uuagaaaggugcaaacaagg

SEQ ID NO: 3389 - RNA, 14 nt, Artificial Sequence
  synthetic polynucleotide
uugcaccuuucuaa

SEQ ID NO: 3390 - RNA, 20 nt, Artificial Sequence
  synthetic polynucleotide
uuagaaaggugcaaacaagg

SEQ ID NO: 3391 - RNA, 14 nt, Artificial Sequence
  synthetic polynucleotide
uugcaccuuucuaa

SEQ ID NO: 3392 - RNA, 20 nt, Artificial Sequence
  synthetic polynucleotide
uuagaaaggugcaaacaagg

SEQ ID NO: 3393 - RNA, 14 nt, Artificial Sequence
  synthetic polynucleotide
uugcaccuuucuaa

SEQ ID NO: 3394 - RNA, 20 nt, Artificial Sequence
  synthetic polynucleotide
uuagaaaggugcaaacaagg

SEQ ID NO: 3395 - RNA, 14 nt, Artificial Sequence
  synthetic polynucleotide
uugcaccuuucuaa

SEQ ID NO: 3396 - RNA, 20 nt, Artificial Sequence
  synthetic polynucleotide
uuagaaaggugcaaacaagg

SEQ ID NO: 3397 - RNA, 14 nt, Artificial Sequence
  synthetic polynucleotide
uugcaccuuucuaa

SEQ ID NO: 3398 - RNA, 20 nt, Artificial Sequence
  synthetic polynucleotide
uuagaaaggugcaaacaagg

SEQ ID NO: 3399 - RNA, 14 nt, Artificial Sequence
  synthetic polynucleotide
uugcaccuuucuaa

SEQ ID NO: 3400 - RNA, 20 nt, Artificial Sequence
  synthetic polynucleotide
uuagaaaggugcaaacaagg

SEQ ID NO: 3401 - RNA, 13 nt, Artificial Sequence
  synthetic polynucleotide
ccuuucuaguuga

SEQ ID NO: 3402 - RNA, 19 nt, Artificial Sequence
  synthetic polynucleotide
ucaacuagaaaggugcaaa

SEQ ID NO: 3403 - RNA, 13 nt, Artificial Sequence
  synthetic polynucleotide
ccuuucuaguuga

SEQ ID NO: 3404 - RNA, 19 nt, Artificial Sequence
  synthetic polynucleotide
ucaacuagaaaggugcaaa

SEQ ID NO: 3405 - RNA, 13 nt, Artificial Sequence
  synthetic polynucleotide
ccuuucuaguuga

SEQ ID NO: 3406 - RNA, 19 nt, Artificial Sequence
  synthetic polynucleotide
ucaacuagaaaggugcaaa

SEQ ID NO: 3407 - RNA, 13 nt, Artificial Sequence
  synthetic polynucleotide
ccuuucuaguuga

SEQ ID NO: 3408 - RNA, 19 nt, Artificial Sequence
  synthetic polynucleotide
ucaacuagaaaggugcaaa

SEQ ID NO: 3409 - RNA, 13 nt, Artificial Sequence
  synthetic polynucleotide
ccuuucuaguuga

SEQ ID NO: 3410 - RNA, 19 nt, Artificial Sequence
  synthetic polynucleotide
ucaacuagaaaggugcaaa

SEQ ID NO: 3411 - RNA, 13 nt, Artificial Sequence
  synthetic polynucleotide
ccuuucuaguuga

SEQ ID NO: 3412 - RNA, 19 nt, Artificial Sequence
  synthetic polynucleotide
ucaacuagaaaggugcaaa

SEQ ID NO: 3413 - RNA, 13 nt, Artificial Sequence
  synthetic polynucleotide
ccuuucuaguuga

SEQ ID NO: 3414 - RNA, 19 nt, Artificial Sequence
  synthetic polynucleotide
ucaacuagaaaggugcaaa

SEQ ID NO: 3415 - RNA, 13 nt, Artificial Sequence
  synthetic polynucleotide
ccuuucuaguuga

SEQ ID NO: 3416 - RNA, 19 nt, Artificial Sequence
  synthetic polynucleotide
ucaacuagaaaggugcaaa

SEQ ID NO: 3417 - RNA, 13 nt, Artificial Sequence
  synthetic polynucleotide
ccuuucuaguuga

SEQ ID NO: 3418 - RNA, 19 nt, Artificial Sequence
  synthetic polynucleotide
ucaacuagaaaggugcaaa

SEQ ID NO: 3419 - RNA, 13 nt, Artificial Sequence
  synthetic polynucleotide
ccuuucuaguuga

SEQ ID NO: 3420 - RNA, 19 nt, Artificial Sequence
  synthetic polynucleotide
ucaacuagaaaggugcaaa

SEQ ID NO: 3421 - RNA, 13 nt, Artificial Sequence
  synthetic polynucleotide
ccuuucuaguuga

SEQ ID NO: 3422 - RNA, 19 nt, Artificial Sequence
  synthetic polynucleotide
ucaacuagaaaggugcaaa

SEQ ID NO: 3423 - RNA, 13 nt, Artificial Sequence
  synthetic polynucleotide
ccuuucuaguuga

SEQ ID NO: 3424 - RNA, 19 nt, Artificial Sequence
  synthetic polynucleotide
ucaacuagaaaggugcaaa

SEQ ID NO: 3425 - RNA, 13 nt, Artificial Sequence
  synthetic polynucleotide
ccuuucuaguuga

SEQ ID NO: 3426 - RNA, 19 nt, Artificial Sequence
  synthetic polynucleotide
ucaacuagaaaggugcaaa

SEQ ID NO: 3427 - RNA, 13 nt, Artificial Sequence
  synthetic polynucleotide
gcaccuuucuaga

SEQ ID NO: 3428 - RNA, 19 nt, Artificial Sequence
  synthetic polynucleotide
ucuagaaaggugcaaacau

SEQ ID NO: 3429 - RNA, 13 nt, Artificial Sequence
  synthetic polynucleotide
gcaccuuucuaga

SEQ ID NO: 3430 - RNA, 19 nt, Artificial Sequence
  synthetic polynucleotide
ucuagaaaggugcaaacau

SEQ ID NO: 3431 - RNA, 13 nt, Artificial Sequence
  synthetic polynucleotide
gcaccuuucuaga

SEQ ID NO: 3432 - RNA, 19 nt, Artificial Sequence
  synthetic polynucleotide
ucuagaaaggugcaaacau

SEQ ID NO: 3433 - RNA, 13 nt, Artificial Sequence
  synthetic polynucleotide
gcaccuuucuaga

SEQ ID NO: 3434 - RNA, 19 nt, Artificial Sequence
  synthetic polynucleotide
ucuagaaaggugcaaacau

SEQ ID NO: 3435 - RNA, 13 nt, Artificial Sequence
  synthetic polynucleotide
gcaccuuucuaga

SEQ ID NO: 3436 - RNA, 19 nt, Artificial Sequence
  synthetic polynucleotide
ucuagaaaggugcaaacau

SEQ ID NO: 3437 - RNA, 13 nt, Artificial Sequence
  synthetic polynucleotide
gcaccuuucuaga

SEQ ID NO: 3438 - RNA, 19 nt, Artificial Sequence
  synthetic polynucleotide
ucuagaaaggugcaaacau

SEQ ID NO: 3439 - RNA, 13 nt, Artificial Sequence
  synthetic polynucleotide
gcaccuuucuaga

SEQ ID NO: 3440 - RNA, 19 nt, Artificial Sequence
  synthetic polynucleotide
ucuagaaaggugcaaacau

SEQ ID NO: 3441 - RNA, 13 nt, Artificial Sequence
  synthetic polynucleotide
gcaccuuucuaga

SEQ ID NO: 3442 - RNA, 19 nt, Artificial Sequence
  synthetic polynucleotide
ucuagaaaggugcaaacau

SEQ ID NO: 3443 - RNA, 13 nt, Artificial Sequence
  synthetic polynucleotide
gcaccuuucuaga

SEQ ID NO: 3444 - RNA, 19 nt, Artificial Sequence
  synthetic polynucleotide
ucuagaaaggugcaaacau

SEQ ID NO: 3445 - RNA, 14 nt, Artificial Sequence
  synthetic polynucleotide
uugcaccuuucuaa

SEQ ID NO: 3446 - RNA, 20 nt, Artificial Sequence
  synthetic polynucleotide
uuagaaaggugcaaacaagg

SEQ ID NO: 3447 - RNA, 14 nt, Artificial Sequence
  synthetic polynucleotide
uugcaccuuucuaa

SEQ ID NO: 3448 - RNA, 20 nt, Artificial Sequence
  synthetic polynucleotide
uuagaaaggugcaaacaagg

SEQ ID NO: 3449 - RNA, 14 nt, Artificial Sequence
  synthetic polynucleotide
uugcaccuuucuaa

SEQ ID NO: 3450 - RNA, 20 nt, Artificial Sequence
  synthetic polynucleotide
uuagaaaggugcaaacaagg

SEQ ID NO: 3451 - RNA, 14 nt, Artificial Sequence
  synthetic polynucleotide
uugcaccuuucuaa

SEQ ID NO: 3452 - RNA, 20 nt, Artificial Sequence
  synthetic polynucleotide
uuagaaaggugcaaacaagg

SEQ ID NO: 3453 - RNA, 14 nt, Artificial Sequence
  synthetic polynucleotide
uugcaccuuucuaa

SEQ ID NO: 3454 - RNA, 20 nt, Artificial Sequence
  synthetic polynucleotide
uuagaaaggugcaaacaagg

SEQ ID NO: 3455 - RNA, 14 nt, Artificial Sequence
  synthetic polynucleotide
uugcaccuuucuaa

SEQ ID NO: 3456 - RNA, 20 nt, Artificial Sequence
  synthetic polynucleotide
uuagaaaggugcaaacaagg

SEQ ID NO: 3457 - RNA, 14 nt, Artificial Sequence
  synthetic polynucleotide
uugcaccuuucuaa

SEQ ID NO: 3458 - RNA, 20 nt, Artificial Sequence
  synthetic polynucleotide
uuagaaaggugcaaacaagg

SEQ ID NO: 3459 - RNA, 14 nt, Artificial Sequence
  synthetic polynucleotide
uugcaccuuucuaa

SEQ ID NO: 3460 - RNA, 20 nt, Artificial Sequence
  synthetic polynucleotide
uuagaaaggugcaaacaagg

SEQ ID NO: 3461 - RNA, 14 nt, Artificial Sequence
  synthetic polynucleotide
uugcaccuuucuaa

SEQ ID NO: 3462 - RNA, 20 nt, Artificial Sequence
  synthetic polynucleotide
uuagaaaggugcaaacaagg

SEQ ID NO: 3463 - RNA, 14 nt, Artificial Sequence
  synthetic polynucleotide
uugcaccuuucuaa

SEQ ID NO: 3464 - RNA, 20 nt, Artificial Sequence
  synthetic polynucleotide
uuagaaaggugcaaacaagg

SEQ ID NO: 3465 - RNA, 14 nt, Artificial Sequence
  synthetic polynucleotide
uugcaccuuucuaa

SEQ ID NO: 3466 - RNA, 20 nt, Artificial Sequence
  synthetic polynucleotide
uuagaaaggugcaaacaagg

SEQ ID NO: 3467 - RNA, 14 nt, Artificial Sequence
  synthetic polynucleotide
uugcaccuuucuaa

SEQ ID NO: 3468 - RNA, 20 nt, Artificial Sequence
  synthetic polynucleotide
uuagaaaggugcaaacaagg

SEQ ID NO: 3469 - RNA, 13 nt, Artificial Sequence
  synthetic polynucleotide
ccuuucuaguuga

SEQ ID NO: 3470 - RNA, 19 nt, Artificial Sequence
  synthetic polynucleotide
ucaacuagaaaggugcaaa

SEQ ID NO: 3471 - RNA, 13 nt, Artificial Sequence
  synthetic polynucleotide
ccuuucuaguuga

SEQ ID NO: 3472 - RNA, 19 nt, Artificial Sequence
  synthetic polynucleotide
ucaacuagaaaggugcaaa

SEQ ID NO: 3473 - RNA, 13 nt, Artificial Sequence
  synthetic polynucleotide
ccuuucuaguuga

SEQ ID NO: 3474 - RNA, 19 nt, Artificial Sequence
  synthetic polynucleotide
ucaacuagaaaggugcaaa

SEQ ID NO: 3475 - RNA, 13 nt, Artificial Sequence
  synthetic polynucleotide
gcaccuuucuaga

SEQ ID NO: 3476 - RNA, 19 nt, Artificial Sequence
  synthetic polynucleotide
ucuagaaaggugcaaacau

SEQ ID NO: 3477 - RNA, 13 nt, Artificial Sequence
  synthetic polynucleotide
gcaccuuucuaga

SEQ ID NO: 3478 - RNA, 19 nt, Artificial Sequence
  synthetic polynucleotide
ucuagaaaggugcaaacau

SEQ ID NO: 3479 - RNA, 13 nt, Artificial Sequence
  synthetic polynucleotide
gcaccuuucuaga

SEQ ID NO: 3480 - RNA, 19 nt, Artificial Sequence
  synthetic polynucleotide
ucuagaaaggugcaaacau

SEQ ID NO: 3481 - RNA, 13 nt, Artificial Sequence
  synthetic polynucleotide
gcaccuuucuaga

SEQ ID NO: 3482 - RNA, 19 nt, Artificial Sequence
  synthetic polynucleotide
ucuagaaaggugcaaacau

SEQ ID NO: 3483 - RNA, 13 nt, Artificial Sequence
  synthetic polynucleotide
gcaccuuucuaga

SEQ ID NO: 3484 - RNA, 19 nt, Artificial Sequence
  synthetic polynucleotide
ucuagaaaggugcaaacau

SEQ ID NO: 3485 - RNA, 13 nt, Artificial Sequence
  synthetic polynucleotide
gugaccaaaagua

SEQ ID NO: 3486 - RNA, 19 nt, Artificial Sequence
  synthetic polynucleotide
uacuuuuggucacacucuc

SEQ ID NO: 3487 - RNA, 13 nt, Artificial Sequence
  synthetic polynucleotide
gugaccaaaagua

SEQ ID NO: 3488 - RNA, 19 nt, Artificial Sequence
  synthetic polynucleotide
uacuuuuggucacacucuc

SEQ ID NO: 3489 - RNA, 13 nt, Artificial Sequence
  synthetic polynucleotide
gugaccaaaagua

SEQ ID NO: 3490 - RNA, 19 nt, Artificial Sequence
  synthetic polynucleotide
uacuuuuggucacacucuc

SEQ ID NO: 3491 - RNA, 13 nt, Artificial Sequence
  synthetic polynucleotide
gugaccaaaagua

SEQ ID NO: 3492 - RNA, 19 nt, Artificial Sequence
  synthetic polynucleotide
uacuuuuggucacacucuc

SEQ ID NO: 3493 - RNA, 13 nt, Artificial Sequence
  synthetic polynucleotide
gugaccaaaagua

SEQ ID NO: 3494 - RNA, 19 nt, Artificial Sequence
  synthetic polynucleotide
uacuuuuggucacacucuc

SEQ ID NO: 3495 - RNA, 13 nt, Artificial Sequence
  synthetic polynucleotide
gugaccaaaagua

SEQ ID NO: 3496 - RNA, 19 nt, Artificial Sequence
  synthetic polynucleotide
uacuuuuggucacacucuc

SEQ ID NO: 3497 - RNA, 13 nt, Artificial Sequence
  synthetic polynucleotide
gugaccaaaagua

SEQ ID NO: 3498 - RNA, 19 nt, Artificial Sequence
  synthetic polynucleotide
uacuuuuggucacacucuc

SEQ ID NO: 3499 - RNA, 13 nt, Artificial Sequence
  synthetic polynucleotide
gugaccaaaagua

SEQ ID NO: 3500 - RNA, 19 nt, Artificial Sequence
  synthetic polynucleotide
uacuuuuggucacacucuc

SEQ ID NO: 3501 - RNA, 13 nt, Artificial Sequence
  synthetic polynucleotide
gugaccaaaagua

SEQ ID NO: 3502 - RNA, 19 nt, Artificial Sequence
  synthetic polynucleotide
uacuuuuggucacacucuc

SEQ ID NO: 3503 - RNA, 13 nt, Artificial Sequence
  synthetic polynucleotide
gcaccuuucuaga

SEQ ID NO: 3504 - RNA, 19 nt, Artificial Sequence
  synthetic polynucleotide
ucuagaaaggugcaaacau

SEQ ID NO: 3505 - RNA, 13 nt, Artificial Sequence
  synthetic polynucleotide
gugaccaaaagua

SEQ ID NO: 3506 - RNA, 19 nt, Artificial Sequence
  synthetic polynucleotide
uacuuuuggucacacucuc

SEQ ID NO: 3507 - RNA, 13 nt, Artificial Sequence
  synthetic polynucleotide
gugaccaaaagua

SEQ ID NO: 3508 - RNA, 19 nt, Artificial Sequence
  synthetic polynucleotide
uacuuuuggucacacucuc

SEQ ID NO: 3509 - RNA, 13 nt, Artificial Sequence
  synthetic polynucleotide
ggcucuccuucga

SEQ ID NO: 3510 - RNA, 19 nt, Artificial Sequence
  synthetic polynucleotide
ucgaaggagagccauucgc

SEQ ID NO: 3511 - RNA, 13 nt, Artificial Sequence
  synthetic polynucleotide
gacaggaaccugg

SEQ ID NO: 3512 - RNA, 19 nt, Artificial Sequence
  synthetic polynucleotide
ccagguuccugucuuuaug

SEQ ID NO: 3513 - RNA, 13 nt, Artificial Sequence
  synthetic polynucleotide
ccaaggagguuua

SEQ ID NO: 3514 - RNA, 19 nt, Artificial Sequence
  synthetic polynucleotide
uaaaccuccuuggcguagu

SEQ ID NO: 3515 - RNA, 13 nt, Artificial Sequence
  synthetic polynucleotide
auuuccaucuaca

SEQ ID NO: 3516 - RNA, 19 nt, Artificial Sequence
  synthetic polynucleotide
uguagauggaaaucaccuc

SEQ ID NO: 3517 - RNA, 13 nt, Artificial Sequence
  synthetic polynucleotide
uccaucuacaaca

SEQ ID NO: 3518 - RNA, 19 nt, Artificial Sequence
  synthetic polynucleotide
uguuguagauggaaaucac

SEQ ID NO: 3519 - RNA, 13 nt, Artificial Sequence
  synthetic polynucleotide
uuuccaucuacaa

SEQ ID NO: 3520 - RNA, 19 nt, Artificial Sequence
  synthetic polynucleotide
uuguagauggaaaucaccu

SEQ ID NO: 3521 - RNA, 13 nt, Artificial Sequence
  synthetic polynucleotide
cgccaaggagguu

SEQ ID NO: 3522 - RNA, 19 nt, Artificial Sequence
  synthetic polynucleotide
aaccuccuuggcguaguac

SEQ ID NO: 3523 - RNA, 13 nt, Artificial Sequence
  synthetic polynucleotide
guggugaucagaa

SEQ ID NO: 3524 - RNA, 19 nt, Artificial Sequence
  synthetic polynucleotide
uucugaucaccacugguau

SEQ ID NO: 3525 - RNA, 13 nt, Artificial Sequence
  synthetic polynucleotide
cuccugcuaaugu

SEQ ID NO: 3526 - RNA, 19 nt, Artificial Sequence
  synthetic polynucleotide
acauuagcaggagaugugg

SEQ ID NO: 3527 - RNA, 13 nt, Artificial Sequence
  synthetic polynucleotide
accuccacauaua

SEQ ID NO: 3528 - RNA, 19 nt, Artificial Sequence
  synthetic polynucleotide
uauauguggaggugccauc

SEQ ID NO: 3529 - RNA, 13 nt, Artificial Sequence
  synthetic polynucleotide
aaguccacuagga

SEQ ID NO: 3530 - RNA, 19 nt, Artificial Sequence
  synthetic polynucleotide
uccuaguggacuuuauagu

SEQ ID NO: 3531 - RNA, 13 nt, Artificial Sequence
  synthetic polynucleotide
uggugaucagaaa

SEQ ID NO: 3532 - RNA, 19 nt, Artificial Sequence
  synthetic polynucleotide
uuucugaucaccacuggua

SEQ ID NO: 3533 - RNA, 13 nt, Artificial Sequence
  synthetic polynucleotide
aguccacuaggaa

SEQ ID NO: 3534 - RNA, 19 nt, Artificial Sequence
  synthetic polynucleotide
uuccuaguggacuuuauag

SEQ ID NO: 3535 - RNA, 13 nt, Artificial Sequence
  synthetic polynucleotide
acgccaaggaggu

SEQ ID NO: 3536 - RNA, 19 nt, Artificial Sequence
  synthetic polynucleotide
accuccuuggcguaguacu

SEQ ID NO: 3537 - RNA, 13 nt, Artificial Sequence
  synthetic polynucleotide
uauuuauugugua

SEQ ID NO: 3538 - RNA, 19 nt, Artificial Sequence
  synthetic polynucleotide
uacacaauaaauaacucac

SEQ ID NO: 3539 - RNA, 14 nt, Artificial Sequence
  synthetic polynucleotide
uuauuuauugugua

SEQ ID NO: 3540 - RNA, 19 nt, Artificial Sequence
  synthetic polynucleotide
uacacaauaaauaacucac

SEQ ID NO: 3541 - RNA, 13 nt, Artificial Sequence
  synthetic polynucleotide
aucaguguuaaaa

SEQ ID NO: 3542 - RNA, 19 nt, Artificial Sequence
  synthetic polynucleotide
uuuuaacacugaugaacca

SEQ ID NO: 3543 - RNA, 14 nt, Artificial Sequence
  synthetic polynucleotide
caucaguguuaaaa

SEQ ID NO: 3544 - RNA, 19 nt, Artificial Sequence
  synthetic polynucleotide
uuuuaacacugaugaacca

SEQ ID NO: 3545 - RNA, 13 nt, Artificial Sequence
  synthetic polynucleotide
auggcuuaaggaa

SEQ ID NO: 3546 - RNA, 19 nt, Artificial Sequence
  synthetic polynucleotide
uuccuuaagccauccauga

SEQ ID NO: 3547 - RNA, 14 nt, Artificial Sequence
  synthetic polynucleotide
gauggcuuaaggaa

SEQ ID NO: 3548 - RNA, 19 nt, Artificial Sequence
  synthetic polynucleotide
uuccuuaagccauccauga

SEQ ID NO: 3549 - RNA, 13 nt, Artificial Sequence
  synthetic polynucleotide
uuguguucuguua

SEQ ID NO: 3550 - RNA, 19 nt, Artificial Sequence
  synthetic polynucleotide
uaacagaacacaaacuucc

SEQ ID NO: 3551 - RNA, 14 nt, Artificial Sequence
  synthetic polynucleotide
uuuguguucuguua

SEQ ID NO: 3552 - RNA, 19 nt, Artificial Sequence
  synthetic polynucleotide
uaacagaacacaaacuucc

SEQ ID NO: 3553 - RNA, 13 nt, Artificial Sequence
  synthetic polynucleotide
aaauacuuugcca

SEQ ID NO: 3554 - RNA, 19 nt, Artificial Sequence
  synthetic polynucleotide
uggcaaaguauuuggucuc

SEQ ID NO: 3555 - RNA, 14 nt, Artificial Sequence
  synthetic polynucleotide
caaauacuuugcca

SEQ ID NO: 3556 - RNA, 19 nt, Artificial Sequence
  synthetic polynucleotide
uggcaaaguauuuggucuc

SEQ ID NO: 3557 - RNA, 13 nt, Artificial Sequence
  synthetic polynucleotide
cuugcacuacaaa

SEQ ID NO: 3558 - RNA, 19 nt, Artificial Sequence
  synthetic polynucleotide
uuuguagugcaagucaaac

SEQ ID NO: 3559 - RNA, 14 nt, Artificial Sequence
  synthetic polynucleotide
acuugcacuacaaa

SEQ ID NO: 3560 - RNA, 19 nt, Artificial Sequence
  synthetic polynucleotide
uuuguagugcaagucaaac

SEQ ID NO: 3561 - RNA, 13 nt, Artificial Sequence
  synthetic polynucleotide
gaauuuauuagua

SEQ ID NO: 3562 - RNA, 19 nt, Artificial Sequence
  synthetic polynucleotide
uacuaauaaauucuuccag

SEQ ID NO: 3563 - RNA, 14 nt, Artificial Sequence
  synthetic polynucleotide
agaauuuauuagua

SEQ ID NO: 3564 - RNA, 19 nt, Artificial Sequence
  synthetic polynucleotide
uacuaauaaauucuuccag

SEQ ID NO: 3565 - RNA, 13 nt, Artificial Sequence
  synthetic polynucleotide
uugcacuacaaaa

SEQ ID NO: 3566 - RNA, 19 nt, Artificial Sequence
  synthetic polynucleotide
uuuuguagugcaagucaaa

SEQ ID NO: 3567 - RNA, 14 nt, Artificial Sequence
  synthetic polynucleotide
cuugcacuacaaaa

SEQ ID NO: 3568 - RNA, 19 nt, Artificial Sequence
  synthetic polynucleotide
uuuuguagugcaagucaaa

SEQ ID NO: 3569 - RNA, 13 nt, Artificial Sequence
  synthetic polynucleotide
auaaaacagguga

SEQ ID NO: 3570 - RNA, 19 nt, Artificial Sequence
  synthetic polynucleotide
ucaccuguuuuauuuucca

SEQ ID NO: 3571 - RNA, 14 nt, Artificial Sequence
  synthetic polynucleotide
aauaaaacagguga

SEQ ID NO: 3572 - RNA, 19 nt, Artificial Sequence
  synthetic polynucleotide
ucaccuguuuuauuuucca

SEQ ID NO: 3573 - RNA, 13 nt, Artificial Sequence
  synthetic polynucleotide
gacaacaacaaca

SEQ ID NO: 3574 - RNA, 19 nt, Artificial Sequence
  synthetic polynucleotide
uguuguuguugucguuguu

SEQ ID NO: 3575 - RNA, 13 nt, Artificial Sequence
  synthetic polynucleotide
augcuuguaacaa

SEQ ID NO: 3576 - RNA, 19 nt, Artificial Sequence
  synthetic polynucleotide
uuguuacaagcaucaucgu

SEQ ID NO: 3577 - RNA, 13 nt, Artificial Sequence
  synthetic polynucleotide
cagaaacucauga

SEQ ID NO: 3578 - RNA, 19 nt, Artificial Sequence
  synthetic polynucleotide
ucaugaguuucuggcaaag

SEQ ID NO: 3579 - RNA, 13 nt, Artificial Sequence
  synthetic polynucleotide
guauugcuaugca

SEQ ID NO: 3580 - RNA, 19 nt, Artificial Sequence
  synthetic polynucleotide
ugcauagcaauacagaaaa

SEQ ID NO: 3581 - RNA, 13 nt, Artificial Sequence
  synthetic polynucleotide
ccagaaacucaua

SEQ ID NO: 3582 - RNA, 19 nt, Artificial Sequence
  synthetic polynucleotide
uaugaguuucuggcaaagu

SEQ ID NO: 3583 - RNA, 13 nt, Artificial Sequence
  synthetic polynucleotide
acucaaacgagca

SEQ ID NO: 3584 - RNA, 19 nt, Artificial Sequence
  synthetic polynucleotide
ugcucguuugaguucaagu

SEQ ID NO: 3585 - RNA, 13 nt, Artificial Sequence
  synthetic polynucleotide
auaugaccgagaa

SEQ ID NO: 3586 - RNA, 19 nt, Artificial Sequence
  synthetic polynucleotide
uucucggucauauaauaac

SEQ ID NO: 3587 - RNA, 13 nt, Artificial Sequence
  synthetic polynucleotide
cgacgacaacgaa

SEQ ID NO: 3588 - RNA, 19 nt, Artificial Sequence
  synthetic polynucleotide
uucguugucgucgucauca

SEQ ID NO: 3589 - RNA, 13 nt, Artificial Sequence
  synthetic polynucleotide
guaaaccagugaa

SEQ ID NO: 3590 - RNA, 19 nt, Artificial Sequence
  synthetic polynucleotide
uucacugguuuacuaaacu

SEQ ID NO: 3591 - RNA, 13 nt, Artificial Sequence
  synthetic polynucleotide
uugucaguuuaga

SEQ ID NO: 3592 - RNA, 19 nt, Artificial Sequence
  synthetic polynucleotide
ucuaaacugacaaagaacc

SEQ ID NO: 3593 - RNA, 13 nt, Artificial Sequence
  synthetic polynucleotide
ucaucaguguuaa

SEQ ID NO: 3594 - RNA, 19 nt, Artificial Sequence
  synthetic polynucleotide
uuaacacugaugaaccaag

SEQ ID NO: 3595 - RNA, 13 nt, Artificial Sequence
  synthetic polynucleotide
aacucaaacgaga

SEQ ID NO: 3596 - RNA, 19 nt, Artificial Sequence
  synthetic polynucleotide
ucucguuugaguucaaguu

SEQ ID NO: 3597 - RNA, 13 nt, Artificial Sequence
  synthetic polynucleotide
cgacaacaacaaa

SEQ ID NO: 3598 - RNA, 19 nt, Artificial Sequence
  synthetic polynucleotide
uuuguuguugucguuguuc

SEQ ID NO: 3599 - RNA, 13 nt, Artificial Sequence
  synthetic polynucleotide
acgacaacgauga

SEQ ID NO: 3600 - RNA, 19 nt, Artificial Sequence
  synthetic polynucleotide
ucaucguugucgucgucau

SEQ ID NO: 3601 - RNA, 13 nt, Artificial Sequence
  synthetic polynucleotide
gcugccuaaggaa

SEQ ID NO: 3602 - RNA, 19 nt, Artificial Sequence
  synthetic polynucleotide
uuccuuaggcagcugauac

SEQ ID NO: 3603 - RNA, 13 nt, Artificial Sequence
  synthetic polynucleotide
auucuacauuuca

SEQ ID NO: 3604 - RNA, 19 nt, Artificial Sequence
  synthetic polynucleotide
ugaaauguagaauaaggcc

SEQ ID NO: 3605 - RNA, 14 nt, Artificial Sequence
  synthetic polynucleotide
caucaguguuaaaa

SEQ ID NO: 3606 - RNA, 19 nt, Artificial Sequence
  synthetic polynucleotide
uuuuaacacugaugaacca

SEQ ID NO: 3607 - RNA, 14 nt, Artificial Sequence
  synthetic polynucleotide
caucaguguuaaaa

SEQ ID NO: 3608 - RNA, 19 nt, Artificial Sequence
  synthetic polynucleotide
uuuuaacacugaugaacca

SEQ ID NO: 3609 - RNA, 14 nt, Artificial Sequence
  synthetic polynucleotide
caucaguguuaaaa

SEQ ID NO: 3610 - RNA, 19 nt, Artificial Sequence
  synthetic polynucleotide
uuuuaacacugaugaacca

SEQ ID NO: 3611 - RNA, 14 nt, Artificial Sequence
  synthetic polynucleotide
caucaguguuaaaa

SEQ ID NO: 3612 - RNA, 19 nt, Artificial Sequence
  synthetic polynucleotide
uuuuaacacugaugaacca

SEQ ID NO: 3613 - RNA, 13 nt, Artificial Sequence
  synthetic polynucleotide
ucaucaguguuaa

SEQ ID NO: 3614 - RNA, 19 nt, Artificial Sequence
  synthetic polynucleotide
uuaacacugaugaaccaag

SEQ ID NO: 3615 - RNA, 13 nt, Artificial Sequence
  synthetic polynucleotide
ucaucaguguuaa

SEQ ID NO: 3616 - RNA, 19 nt, Artificial Sequence
  synthetic polynucleotide
uuaacacugaugaaccaag

SEQ ID NO: 3617 - RNA, 13 nt, Artificial Sequence
  synthetic polynucleotide
ucaucaguguuaa

SEQ ID NO: 3618 - RNA, 19 nt, Artificial Sequence
  synthetic polynucleotide
uuaacacugaugaaccaag

SEQ ID NO: 3619 - RNA, 13 nt, Artificial Sequence
  synthetic polynucleotide
ucaucaguguuaa

SEQ ID NO: 3620 - RNA, 19 nt, Artificial Sequence
  synthetic polynucleotide
uuaacacugaugaaccaag

SEQ ID NO: 3621 - RNA, 13 nt, Artificial Sequence
  synthetic polynucleotide
ucaucaguguuaa

SEQ ID NO: 3622 - RNA, 19 nt, Artificial Sequence
  synthetic polynucleotide
uuaacacugaugaaccaag

SEQ ID NO: 3623 - RNA, 13 nt, Artificial Sequence
  synthetic polynucleotide
ucaucaguguuaa

SEQ ID NO: 3624 - RNA, 19 nt, Artificial Sequence
  synthetic polynucleotide
uuaacacugaugaaccaag

SEQ ID NO: 3625 - RNA, 13 nt, Artificial Sequence
  synthetic polynucleotide
ucaucaguguuaa

SEQ ID NO: 3626 - RNA, 19 nt, Artificial Sequence
  synthetic polynucleotide
uuaacacugaugaaccaag

SEQ ID NO: 3627 - RNA, 13 nt, Artificial Sequence
  synthetic polynucleotide
ucaucaguguuaa

SEQ ID NO: 3628 - RNA, 19 nt, Artificial Sequence
  synthetic polynucleotide
uuaacacugaugaaccaag

SEQ ID NO: 3629 - RNA, 13 nt, Artificial Sequence
  synthetic polynucleotide
ucaucaguguuaa

SEQ ID NO: 3630 - RNA, 19 nt, Artificial Sequence
  synthetic polynucleotide
uuaacacugaugaaccaag

SEQ ID NO: 3631 - RNA, 13 nt, Artificial Sequence
  synthetic polynucleotide
ucaucaguguuaa

SEQ ID NO: 3632 - RNA, 19 nt, Artificial Sequence
  synthetic polynucleotide
uuaacacugaugaaccaag

SEQ ID NO: 3633 - RNA, 13 nt, Artificial Sequence
  synthetic polynucleotide
ucaucaguguuaa

SEQ ID NO: 3634 - RNA, 19 nt, Artificial Sequence
  synthetic polynucleotide
uuaacacugaugaaccaag

SEQ ID NO: 3635 - RNA, 13 nt, Artificial Sequence
  synthetic polynucleotide
ucaucaguguuaa

SEQ ID NO: 3636 - RNA, 19 nt, Artificial Sequence
  synthetic polynucleotide
uuaacacugaugaaccaag

SEQ ID NO: 3637 - RNA, 13 nt, Artificial Sequence
  synthetic polynucleotide
ucaucaguguuaa

SEQ ID NO: 3638 - RNA, 19 nt, Artificial Sequence
  synthetic polynucleotide
uuaacacugaugaaccaag

SEQ ID NO: 3639 - RNA, 13 nt, Artificial Sequence
  synthetic polynucleotide
ucaucaguguuaa

SEQ ID NO: 3640 - RNA, 19 nt, Artificial Sequence
  synthetic polynucleotide
uuaacacugaugaaccaag

SEQ ID NO: 3641 - RNA, 13 nt, Artificial Sequence
  synthetic polynucleotide
gcuaaugguggaa

SEQ ID NO: 3642 - RNA, 19 nt, Artificial Sequence
  synthetic polynucleotide
uuccaccauuagcacgcgg

SEQ ID NO: 3643 - RNA, 13 nt, Artificial Sequence
  synthetic polynucleotide
ugaucgugcgcuc

SEQ ID NO: 3644 - RNA, 19 nt, Artificial Sequence
  synthetic polynucleotide
gagcgcacgaucauguugg

SEQ ID NO: 3645 - RNA, 13 nt, Artificial Sequence
  synthetic polynucleotide
caauuccuggcga

SEQ ID NO: 3646 - RNA, 19 nt, Artificial Sequence
  synthetic polynucleotide
ucgccaggaauuguugcug

SEQ ID NO: 3647 - RNA, 13 nt, Artificial Sequence
  synthetic polynucleotide
aguggauccacga

SEQ ID NO: 3648 - RNA, 19 nt, Artificial Sequence
  synthetic polynucleotide
ucguggauccacuuccagc

SEQ ID NO: 3649 - RNA, 13 nt, Artificial Sequence
  synthetic polynucleotide
uacagcaaggucc

SEQ ID NO: 3650 - RNA, 19 nt, Artificial Sequence
  synthetic polynucleotide
ggaccuugcuguacugcgu

SEQ ID NO: 3651 - RNA, 13 nt, Artificial Sequence
  synthetic polynucleotide
aacaugaucgugc

SEQ ID NO: 3652 - RNA, 19 nt, Artificial Sequence
  synthetic polynucleotide
gcacgaucauguuggacag

SEQ ID NO: 3653 - RNA, 13 nt, Artificial Sequence
  synthetic polynucleotide
acaugaucgugcg

SEQ ID NO: 3654 - RNA, 19 nt, Artificial Sequence
  synthetic polynucleotide
cgcacgaucauguuggaca

SEQ ID NO: 3655 - RNA, 13 nt, Artificial Sequence
  synthetic polynucleotide
cagcaagguccug

SEQ ID NO: 3656 - RNA, 19 nt, Artificial Sequence
  synthetic polynucleotide
caggaccuugcuguacugc

SEQ ID NO: 3657 - RNA, 13 nt, Artificial Sequence
  synthetic polynucleotide
ccaacaugaucgu

SEQ ID NO: 3658 - RNA, 19 nt, Artificial Sequence
  synthetic polynucleotide
acgaucauguuggacagcu

SEQ ID NO: 3659 - RNA, 13 nt, Artificial Sequence
  synthetic polynucleotide
agcggaagcgcau

SEQ ID NO: 3660 - RNA, 19 nt, Artificial Sequence
  synthetic polynucleotide
augcgcuuccgcuucacca

SEQ ID NO: 3661 - RNA, 13 nt, Artificial Sequence
  synthetic polynucleotide
gcaucgaggccau

SEQ ID NO: 3662 - RNA, 19 nt, Artificial Sequence
  synthetic polynucleotide
auggccucgaugcgcuucc

SEQ ID NO: 3663 - RNA, 13 nt, Artificial Sequence
  synthetic polynucleotide
gacuaucgacaug

SEQ ID NO: 3664 - RNA, 19 nt, Artificial Sequence
  synthetic polynucleotide
caugucgauagucuugcag

SEQ ID NO: 3665 - RNA, 13 nt, Artificial Sequence
  synthetic polynucleotide
accugcaagacua

SEQ ID NO: 3666 - RNA, 19 nt, Artificial Sequence
  synthetic polynucleotide
uagucuugcagguggauag

SEQ ID NO: 3667 - RNA, 13 nt, Artificial Sequence
  synthetic polynucleotide
gcuccacggagaa

SEQ ID NO: 3668 - RNA, 19 nt, Artificial Sequence
  synthetic polynucleotide
uucuccguggagcugaagc

SEQ ID NO: 3669 - RNA, 13 nt, Artificial Sequence
  synthetic polynucleotide
cacagcauauaua

SEQ ID NO: 3670 - RNA, 19 nt, Artificial Sequence
  synthetic polynucleotide
uauauaugcuguguguacu

SEQ ID NO: 3671 - RNA, 13 nt, Artificial Sequence
  synthetic polynucleotide
cagcauauauaua

SEQ ID NO: 3672 - RNA, 19 nt, Artificial Sequence
  synthetic polynucleotide
uauauauaugcugugugua

SEQ ID NO: 3673 - RNA, 13 nt, Artificial Sequence
  synthetic polynucleotide
guacauugacuua

SEQ ID NO: 3674 - RNA, 19 nt, Artificial Sequence
  synthetic polynucleotide
uaagucaauguacagcugc

SEQ ID NO: 3675 - RNA, 14 nt, Artificial Sequence
  synthetic polynucleotide
uguacauugacuua

SEQ ID NO: 3676 - RNA, 19 nt, Artificial Sequence
  synthetic polynucleotide
uaagucaauguacagcugc

SEQ ID NO: 3677 - RNA, 13 nt, Artificial Sequence
  synthetic polynucleotide
aacuauugcuuca

SEQ ID NO: 3678 - RNA, 19 nt, Artificial Sequence
  synthetic polynucleotide
ugaagcaauaguugguguc

SEQ ID NO: 3679 - RNA, 14 nt, Artificial Sequence
  synthetic polynucleotide
caacuauugcuuca

SEQ ID NO: 3680 - RNA, 19 nt, Artificial Sequence
  synthetic polynucleotide
ugaagcaauaguugguguc

SEQ ID NO: 3681 - RNA, 13 nt, Artificial Sequence
  synthetic polynucleotide
gcauauauaugua

SEQ ID NO: 3682 - RNA, 19 nt, Artificial Sequence
  synthetic polynucleotide
uacauauauaugcugugug

SEQ ID NO: 3683 - RNA, 13 nt, Artificial Sequence
  synthetic polynucleotide
uguacauugacua

SEQ ID NO: 3684 - RNA, 19 nt, Artificial Sequence
  synthetic polynucleotide
uagucaauguacagcugcc

SEQ ID NO: 3685 - RNA, 14 nt, Artificial Sequence
  synthetic polynucleotide
cuguacauugacua

SEQ ID NO: 3686 - RNA, 19 nt, Artificial Sequence
  synthetic polynucleotide
uagucaauguacagcugcc

SEQ ID NO: 3687 - RNA, 13 nt, Artificial Sequence
  synthetic polynucleotide
agcauauauauga

SEQ ID NO: 3688 - RNA, 19 nt, Artificial Sequence
  synthetic polynucleotide
ucauauauaugcugugugu

SEQ ID NO: 3689 - RNA, 13 nt, Artificial Sequence
  synthetic polynucleotide
cagcaacaauuca

SEQ ID NO: 3690 - RNA, 19 nt, Artificial Sequence
  synthetic polynucleotide
ugaauuguugcuguauuuc

SEQ ID NO: 3691 - RNA, 13 nt, Artificial Sequence
  synthetic polynucleotide
cauauauauguua

SEQ ID NO: 3692 - RNA, 19 nt, Artificial Sequence
  synthetic polynucleotide
uaacauauauaugcugugu

SEQ ID NO: 3693 - RNA, 13 nt, Artificial Sequence
  synthetic polynucleotide
uugcuucagcuca

SEQ ID NO: 3694 - RNA, 19 nt, Artificial Sequence
  synthetic polynucleotide
ugagcugaagcaauaguug

SEQ ID NO: 3695 - RNA, 14 nt, Artificial Sequence
  synthetic polynucleotide
auugcuucagcuca

SEQ ID NO: 3696 - RNA, 19 nt, Artificial Sequence
  synthetic polynucleotide
ugagcugaagcaauaguug

SEQ ID NO: 3697 - RNA, 13 nt, Artificial Sequence
  synthetic polynucleotide
acagcauauauaa

SEQ ID NO: 3698 - RNA, 19 nt, Artificial Sequence
  synthetic polynucleotide
uuauauaugcuguguguac

SEQ ID NO: 3699 - RNA, 13 nt, Artificial Sequence
  synthetic polynucleotide
auugcuucagcua

SEQ ID NO: 3700 - RNA, 19 nt, Artificial Sequence
  synthetic polynucleotide
uagcugaagcaauaguugg

SEQ ID NO: 3701 - RNA, 14 nt, Artificial Sequence
  synthetic polynucleotide
uauugcuucagcua

SEQ ID NO: 3702 - RNA, 19 nt, Artificial Sequence
  synthetic polynucleotide
uagcugaagcaauaguugg

SEQ ID NO: 3703 - RNA, 13 nt, Artificial Sequence
  synthetic polynucleotide
caaguucaagcaa

SEQ ID NO: 3704 - RNA, 19 nt, Artificial Sequence
  synthetic polynucleotide
uugcuugaacuugucauag

SEQ ID NO: 3705 - RNA, 13 nt, Artificial Sequence
  synthetic polynucleotide
cagaguacacaca

SEQ ID NO: 3706 - RNA, 19 nt, Artificial Sequence
  synthetic polynucleotide
uguguguacucugcuugaa

SEQ ID NO: 3707 - RNA, 13 nt, Artificial Sequence
  synthetic polynucleotide
acacacagcauaa

SEQ ID NO: 3708 - RNA, 19 nt, Artificial Sequence
  synthetic polynucleotide
uuaugcuguguguacucug

SEQ ID NO: 3709 - RNA, 13 nt, Artificial Sequence
  synthetic polynucleotide
cagcauauauaua

SEQ ID NO: 3710 - RNA, 19 nt, Artificial Sequence
  synthetic polynucleotide
uauauauaugcugugugua

SEQ ID NO: 3711 - RNA, 13 nt, Artificial Sequence
  synthetic polynucleotide
ucaagcagaguaa

SEQ ID NO: 3712 - RNA, 19 nt, Artificial Sequence
  synthetic polynucleotide
uuacucugcuugaacuugu

SEQ ID NO: 3713 - RNA, 13 nt, Artificial Sequence
  synthetic polynucleotide
agcauauauauga

SEQ ID NO: 3714 - RNA, 19 nt, Artificial Sequence
  synthetic polynucleotide
ucauauauaugcugugugu

SEQ ID NO: 3715 - RNA, 13 nt, Artificial Sequence
  synthetic polynucleotide
agaguacacacaa

SEQ ID NO: 3716 - RNA, 19 nt, Artificial Sequence
  synthetic polynucleotide
uuguguguacucugcuuga

SEQ ID NO: 3717 - RNA, 13 nt, Artificial Sequence
  synthetic polynucleotide
aagcagaguacaa

SEQ ID NO: 3718 - RNA, 19 nt, Artificial Sequence
  synthetic polynucleotide
uuguacucugcuugaacuu

SEQ ID NO: 3719 - RNA, 13 nt, Artificial Sequence
  synthetic polynucleotide
uucaacacaucaa

SEQ ID NO: 3720 - RNA, 19 nt, Artificial Sequence
  synthetic polynucleotide
uugauguguugaagaacau

SEQ ID NO: 3721 - RNA, 13 nt, Artificial Sequence
  synthetic polynucleotide
agcagaguacaca

SEQ ID NO: 3722 - RNA, 19 nt, Artificial Sequence
  synthetic polynucleotide
uguguacucugcuugaacu

SEQ ID NO: 3723 - RNA, 13 nt, Artificial Sequence
  synthetic polynucleotide
auauauguucuua

SEQ ID NO: 3724 - RNA, 19 nt, Artificial Sequence
  synthetic polynucleotide
uaagaacauauauaugcug

SEQ ID NO: 3725 - RNA, 13 nt, Artificial Sequence
  synthetic polynucleotide
gacaaguucaaga

SEQ ID NO: 3726 - RNA, 19 nt, Artificial Sequence
  synthetic polynucleotide
ucuugaacuugucauagau

SEQ ID NO: 3727 - RNA, 13 nt, Artificial Sequence
  synthetic polynucleotide
uuaaagauggaga

SEQ ID NO: 3728 - RNA, 19 nt, Artificial Sequence
  synthetic polynucleotide
ucuccaucuuuaauggggc

SEQ ID NO: 3729 - RNA, 13 nt, Artificial Sequence
  synthetic polynucleotide
cuaugacaaguua

SEQ ID NO: 3730 - RNA, 19 nt, Artificial Sequence
  synthetic polynucleotide
uaacuugucauagauuucg

SEQ ID NO: 3731 - RNA, 13 nt, Artificial Sequence
  synthetic polynucleotide
caacgaaaucuaa

SEQ ID NO: 3732 - RNA, 19 nt, Artificial Sequence
  synthetic polynucleotide
uuagauuucguuguggguu

SEQ ID NO: 3733 - RNA, 13 nt, Artificial Sequence
  synthetic polynucleotide
uaugacaaguuca

SEQ ID NO: 3734 - RNA, 19 nt, Artificial Sequence
  synthetic polynucleotide
ugaacuugucauagauuuc

SEQ ID NO: 3735 - RNA, 13 nt, Artificial Sequence
  synthetic polynucleotide
aaguucaagcaga

SEQ ID NO: 3736 - RNA, 19 nt, Artificial Sequence
  synthetic polynucleotide
ucugcuugaacuugucaua

SEQ ID NO: 3737 - RNA, 13 nt, Artificial Sequence
  synthetic polynucleotide
caagcagaguaca

SEQ ID NO: 3738 - RNA, 19 nt, Artificial Sequence
  synthetic polynucleotide
uguacucugcuugaacuug

SEQ ID NO: 3739 - RNA, 13 nt, Artificial Sequence
  synthetic polynucleotide
aaucuaugacaaa

SEQ ID NO: 3740 - RNA, 19 nt, Artificial Sequence
  synthetic polynucleotide
uuugucauagauuucguug

SEQ ID NO: 3741 - RNA, 13 nt, Artificial Sequence
  synthetic polynucleotide
cacacagcauaua

SEQ ID NO: 3742 - RNA, 19 nt, Artificial Sequence
  synthetic polynucleotide
uauaugcuguguguacucu

SEQ ID NO: 3743 - RNA, 13 nt, Artificial Sequence
  synthetic polynucleotide
gaaauauagcaaa

SEQ ID NO: 3744 - RNA, 19 nt, Artificial Sequence
  synthetic polynucleotide
uuugcuauauuucugguag

SEQ ID NO: 3745 - RNA, 13 nt, Artificial Sequence
  synthetic polynucleotide
gaacucuaccaga

SEQ ID NO: 3746 - RNA, 19 nt, Artificial Sequence
  synthetic polynucleotide
ucugguagaguucuacgug

SEQ ID NO: 3747 - RNA, 13 nt, Artificial Sequence
  synthetic polynucleotide
gcaaagauaauga

SEQ ID NO: 3748 - RNA, 19 nt, Artificial Sequence
  synthetic polynucleotide
ucauuaucuuugcugucac

SEQ ID NO: 3749 - RNA, 13 nt, Artificial Sequence
  synthetic polynucleotide
aacucuaccagaa

SEQ ID NO: 3750 - RNA, 19 nt, Artificial Sequence
  synthetic polynucleotide
uucugguagaguucuacgu

SEQ ID NO: 3751 - RNA, 13 nt, Artificial Sequence
  synthetic polynucleotide
acucuaccagaaa

SEQ ID NO: 3752 - RNA, 19 nt, Artificial Sequence
  synthetic polynucleotide
uuucugguagaguucuacg

SEQ ID NO: 3753 - RNA, 13 nt, Artificial Sequence
  synthetic polynucleotide
acagcaaagauaa

SEQ ID NO: 3754 - RNA, 19 nt, Artificial Sequence
  synthetic polynucleotide
uuaucuuugcugucacaag

SEQ ID NO: 3755 - RNA, 13 nt, Artificial Sequence
  synthetic polynucleotide
caaucuaugacaa

SEQ ID NO: 3756 - RNA, 19 nt, Artificial Sequence
  synthetic polynucleotide
uugucauagauugcguugu

SEQ ID NO: 3757 - RNA, 13 nt, Artificial Sequence
  synthetic polynucleotide
agauucaagucaa

SEQ ID NO: 3758 - RNA, 19 nt, Artificial Sequence
  synthetic polynucleotide
uugacuugaaucucugcag

SEQ ID NO: 3759 - RNA, 13 nt, Artificial Sequence
  synthetic polynucleotide
cuguggagcaaca

SEQ ID NO: 3760 - RNA, 19 nt, Artificial Sequence
  synthetic polynucleotide
uguugcuccacaguugacu

SEQ ID NO: 3761 - RNA, 13 nt, Artificial Sequence
  synthetic polynucleotide
ugacagcaaagaa

SEQ ID NO: 3762 - RNA, 19 nt, Artificial Sequence
  synthetic polynucleotide
uucuuugcugucacaagag

SEQ ID NO: 3763 - RNA, 13 nt, Artificial Sequence
  synthetic polynucleotide
augacaaaaccaa

SEQ ID NO: 3764 - RNA, 19 nt, Artificial Sequence
  synthetic polynucleotide
uugguuuugucauagauug

SEQ ID NO: 3765 - RNA, 13 nt, Artificial Sequence
  synthetic polynucleotide
gagauucaaguca

SEQ ID NO: 3766 - RNA, 19 nt, Artificial Sequence
  synthetic polynucleotide
ugacuugaaucucugcagg

SEQ ID NO: 3767 - RNA, 13 nt, Artificial Sequence
  synthetic polynucleotide
cacacagcauaua

SEQ ID NO: 3768 - RNA, 19 nt, Artificial Sequence
  synthetic polynucleotide
uauaugcuguguguacucu

SEQ ID NO: 3769 - RNA, 13 nt, Artificial Sequence
  synthetic polynucleotide
cacacagcauaua

SEQ ID NO: 3770 - RNA, 19 nt, Artificial Sequence
  synthetic polynucleotide
uauaugcuguguguacucu

SEQ ID NO: 3771 - RNA, 13 nt, Artificial Sequence
  synthetic polynucleotide
cacacagcauaua

SEQ ID NO: 3772 - RNA, 19 nt, Artificial Sequence
  synthetic polynucleotide
uauaugcuguguguacucu

SEQ ID NO: 3773 - RNA, 13 nt, Artificial Sequence
  synthetic polynucleotide
cacacagcauaua

SEQ ID NO: 3774 - RNA, 19 nt, Artificial Sequence
  synthetic polynucleotide
uauaugcuguguguacucu

SEQ ID NO: 3775 - RNA, 13 nt, Artificial Sequence
  synthetic polynucleotide
cacacagcauaua

SEQ ID NO: 3776 - RNA, 19 nt, Artificial Sequence
  synthetic polynucleotide
uauaugcuguguguacucu

SEQ ID NO: 3777 - RNA, 13 nt, Artificial Sequence
  synthetic polynucleotide
cacacagcauaua

SEQ ID NO: 3778 - RNA, 19 nt, Artificial Sequence
  synthetic polynucleotide
uauaugcuguguguacucu

SEQ ID NO: 3779 - RNA, 13 nt, Artificial Sequence
  synthetic polynucleotide
cacacagcauaua

SEQ ID NO: 3780 - RNA, 19 nt, Artificial Sequence
  synthetic polynucleotide
uauaugcuguguguacucu

SEQ ID NO: 3781 - RNA, 13 nt, Artificial Sequence
  synthetic polynucleotide
cacacagcauaua

SEQ ID NO: 3782 - RNA, 19 nt, Artificial Sequence
  synthetic polynucleotide
uauaugcuguguguacucu

SEQ ID NO: 3783 - RNA, 13 nt, Artificial Sequence
  synthetic polynucleotide
agauucaagucaa

SEQ ID NO: 3784 - RNA, 19 nt, Artificial Sequence
  synthetic polynucleotide
uugacuugaaucucugcuu

SEQ ID NO: 3785 - RNA, 13 nt, Artificial Sequence
  synthetic polynucleotide
cacacagcauaua

SEQ ID NO: 3786 - RNA, 19 nt, Artificial Sequence
  synthetic polynucleotide
uauaugcuguguguacucu

SEQ ID NO: 3787 - RNA, 13 nt, Artificial Sequence
  synthetic polynucleotide
cacacagcauaua

SEQ ID NO: 3788 - RNA, 19 nt, Artificial Sequence
  synthetic polynucleotide
uauaugcuguguguacucu

SEQ ID NO: 3789 - RNA, 13 nt, Artificial Sequence
  synthetic polynucleotide
cacacagcauaua

SEQ ID NO: 3790 - RNA, 19 nt, Artificial Sequence
  synthetic polynucleotide
uauaugcuguguguacucu

SEQ ID NO: 3791 - RNA, 13 nt, Artificial Sequence
  synthetic polynucleotide
cacacagcauaua

SEQ ID NO: 3792 - RNA, 19 nt, Artificial Sequence
  synthetic polynucleotide
uauaugcuguguguacucu

SEQ ID NO: 3793 - RNA, 13 nt, Artificial Sequence
  synthetic polynucleotide
cacacagcauaua

SEQ ID NO: 3794 - RNA, 19 nt, Artificial Sequence
  synthetic polynucleotide
uauaugcuguguguacucu

SEQ ID NO: 3795 - RNA, 19 nt, Artificial Sequence
  synthetic polynucleotide
augucuguguccacagaca

SEQ ID NO: 3796 - RNA, 25 nt, Artificial Sequence
  synthetic polynucleotide
guaaccaugucuguguccacagaca

SEQ ID NO: 3797 - RNA, 19 nt, Artificial Sequence
  synthetic polynucleotide
aaccaugucuguguccaca

SEQ ID NO: 3798 - RNA, 25 nt, Artificial Sequence
  synthetic polynucleotide
caagguaaccaugucuguguccaca

SEQ ID NO: 3799 - RNA, 19 nt, Artificial Sequence
  synthetic polynucleotide
uaaccaugucuguguccac

SEQ ID NO: 3800 - RNA, 25 nt, Artificial Sequence
  synthetic polynucleotide
ccaagguaaccaugucuguguccaa

SEQ ID NO: 3801 - RNA, 19 nt, Artificial Sequence
  synthetic polynucleotide
guaaccaugucugugucca

SEQ ID NO: 3802 - RNA, 25 nt, Artificial Sequence
  synthetic polynucleotide
gccaagguaaccaugucugugucca

SEQ ID NO: 3803 - RNA, 19 nt, Artificial Sequence
  synthetic polynucleotide
aaagcugcaucaagagcac

SEQ ID NO: 3804 - RNA, 25 nt, Artificial Sequence
  synthetic polynucleotide
ccgcagaaagcugcaucaagagcaa

SEQ ID NO: 3805 - RNA, 19 nt, Artificial Sequence
  synthetic polynucleotide
gaaagcugcaucaagagca

SEQ ID NO: 3806 - RNA, 25 nt, Artificial Sequence
  synthetic polynucleotide
gccgcagaaagcugcaucaagagca

SEQ ID NO: 3807 - RNA, 19 nt, Artificial Sequence
  synthetic polynucleotide
caucuaugcucugaggagu

SEQ ID NO: 3808 - RNA, 25 nt, Artificial Sequence
  synthetic polynucleotide
ccccaucaucuaugcucugaggaga

SEQ ID NO: 3809 - RNA, 19 nt, Artificial Sequence
  synthetic polynucleotide
ucaucuaugcucugaggag

SEQ ID NO: 3810 - RNA, 25 nt, Artificial Sequence
  synthetic polynucleotide
accccaucaucuaugcucugaggaa

SEQ ID NO: 3811 - RNA, 19 nt, Artificial Sequence
  synthetic polynucleotide
aucaucuaugcucugagga

SEQ ID NO: 3812 - RNA, 25 nt, Artificial Sequence
  synthetic polynucleotide
aaccccaucaucuaugcucugagga

SEQ ID NO: 3813 - RNA, 19 nt, Artificial Sequence
  synthetic polynucleotide
caucaucuaugcucugagg

SEQ ID NO: 3814 - RNA, 25 nt, Artificial Sequence
  synthetic polynucleotide
gaaccccaucaucuaugcucugaga

SEQ ID NO: 3815 - RNA, 19 nt, Artificial Sequence
  synthetic polynucleotide
ccaucaucuaugcucugag

SEQ ID NO: 3816 - RNA, 25 nt, Artificial Sequence
  synthetic polynucleotide
ugaaccccaucaucuaugcucugaa

SEQ ID NO: 3817 - RNA, 19 nt, Artificial Sequence
  synthetic polynucleotide
cccaucaucuaugcucuga

SEQ ID NO: 3818 - RNA, 25 nt, Artificial Sequence
  synthetic polynucleotide
gugaaccccaucaucuaugcucuga

SEQ ID NO: 3819 - RNA, 19 nt, Artificial Sequence
  synthetic polynucleotide
accccaucaucuaugcucu

SEQ ID NO: 3820 - RNA, 25 nt, Artificial Sequence
  synthetic polynucleotide
ccgugaaccccaucaucuaugcuca

SEQ ID NO: 3821 - RNA, 19 nt, Artificial Sequence
  synthetic polynucleotide
aaccccaucaucuaugcuc

SEQ ID NO: 3822 - RNA, 25 nt, Artificial Sequence
  synthetic polynucleotide
accgugaaccccaucaucuaugcua

SEQ ID NO: 3823 - RNA, 19 nt, Artificial Sequence
  synthetic polynucleotide
ugguguugaucaucugcug

SEQ ID NO: 3824 - RNA, 25 nt, Artificial Sequence
  synthetic polynucleotide
uccuggugguguugaucaucugcua

SEQ ID NO: 3825 - RNA, 19 nt, Artificial Sequence
  synthetic polynucleotide
gugguguugaucaucugcu

SEQ ID NO: 3826 - RNA, 25 nt, Artificial Sequence
  synthetic polynucleotide
auccuggugguguugaucaucugca

SEQ ID NO: 3827 - RNA, 19 nt, Artificial Sequence
  synthetic polynucleotide
uggugguguugaucaucug

SEQ ID NO: 3828 - RNA, 25 nt, Artificial Sequence
  synthetic polynucleotide
ugauccuggugguguugaucaucua

SEQ ID NO: 3829 - RNA, 19 nt, Artificial Sequence
  synthetic polynucleotide
cuggugguguugaucaucu

SEQ ID NO: 3830 - RNA, 25 nt, Artificial Sequence
  synthetic polynucleotide
cugauccuggugguguugaucauca

SEQ ID NO: 3831 - RNA, 19 nt, Artificial Sequence
  synthetic polynucleotide
auccuggugguguugauca

SEQ ID NO: 3832 - RNA, 25 nt, Artificial Sequence
  synthetic polynucleotide
guccugauccuggugguguugauca

SEQ ID NO: 3833 - RNA, 19 nt, Artificial Sequence
  synthetic polynucleotide
auucucuggaaggcucaca

SEQ ID NO: 3834 - RNA, 25 nt, Artificial Sequence
  synthetic polynucleotide
auguauauucucuggaaggcucaca

SEQ ID NO: 3835 - RNA, 19 nt, Artificial Sequence
  synthetic polynucleotide
uauucucuggaaggcucac

SEQ ID NO: 3836 - RNA, 25 nt, Artificial Sequence
  synthetic polynucleotide
cauguauauucucuggaaggcucaa

SEQ ID NO: 3837 - RNA, 19 nt, Artificial Sequence
  synthetic polynucleotide
auauucucuggaaggcuca

SEQ ID NO: 3838 - RNA, 25 nt, Artificial Sequence
  synthetic polynucleotide
acauguauauucucuggaaggcuca

SEQ ID NO: 3839 - RNA, 19 nt, Artificial Sequence
  synthetic polynucleotide
uauauucucuggaaggcuc

SEQ ID NO: 3840 - RNA, 25 nt, Artificial Sequence
  synthetic polynucleotide
uacauguauauucucuggaaggcua

SEQ ID NO: 3841 - RNA, 19 nt, Artificial Sequence
  synthetic polynucleotide
cuaccugauguucuggauc

SEQ ID NO: 3842 - RNA, 25 nt, Artificial Sequence
  synthetic polynucleotide
ugaaaccuaccugauguucuggaua

SEQ ID NO: 3843 - RNA, 19 nt, Artificial Sequence
  synthetic polynucleotide
accuaccugauguucugga

SEQ ID NO: 3844 - RNA, 25 nt, Artificial Sequence
  synthetic polynucleotide
gaugaaaccuaccugauguucugga

SEQ ID NO: 3845 - RNA, 19 nt, Artificial Sequence
  synthetic polynucleotide
aaaccuaccugauguucug

SEQ ID NO: 3846 - RNA, 25 nt, Artificial Sequence
  synthetic polynucleotide
uugaugaaaccuaccugauguucua

SEQ ID NO: 3847 - RNA, 19 nt, Artificial Sequence
  synthetic polynucleotide
gaaaccuaccugauguucu

SEQ ID NO: 3848 - RNA, 25 nt, Artificial Sequence
  synthetic polynucleotide
auugaugaaaccuaccugauguuca

SEQ ID NO: 3849 - RNA, 19 nt, Artificial Sequence
  synthetic polynucleotide
acugcaaucuguuugcuca

SEQ ID NO: 3850 - RNA, 25 nt, Artificial Sequence
  synthetic polynucleotide
cgagaaacugcaaucuguuugcuca

SEQ ID NO: 3851 - RNA, 19 nt, Artificial Sequence
  synthetic polynucleotide
aaacugcaaucuguuugcu

SEQ ID NO: 3852 - RNA, 25 nt, Artificial Sequence
  synthetic polynucleotide
ugcgagaaacugcaaucuguuugca

SEQ ID NO: 3853 - RNA, 19 nt, Artificial Sequence
  synthetic polynucleotide
ccuggccuauaagaggauu

SEQ ID NO: 3854 - RNA, 25 nt, Artificial Sequence
  synthetic polynucleotide
caggccccuggccuauaagaggaua

SEQ ID NO: 3855 - RNA, 19 nt, Artificial Sequence
  synthetic polynucleotide
guacauauccauucacagg

SEQ ID NO: 3856 - RNA, 25 nt, Artificial Sequence
  synthetic polynucleotide
cgacagguacauauccauucacaga

SEQ ID NO: 3857 - RNA, 19 nt, Artificial Sequence
  synthetic polynucleotide
gguacauauccauucacag

SEQ ID NO: 3858 - RNA, 25 nt, Artificial Sequence
  synthetic polynucleotide
ucgacagguacauauccauucacaa

SEQ ID NO: 3859 - RNA, 19 nt, Artificial Sequence
  synthetic polynucleotide
cagguacauauccauucac

SEQ ID NO: 3860 - RNA, 25 nt, Artificial Sequence
  synthetic polynucleotide
caucgacagguacauauccauucaa

SEQ ID NO: 3861 - RNA, 19 nt, Artificial Sequence
  synthetic polynucleotide
acagguacauauccauuca

SEQ ID NO: 3862 - RNA, 25 nt, Artificial Sequence
  synthetic polynucleotide
ccaucgacagguacauauccauuca

SEQ ID NO: 3863 - RNA, 19 nt, Artificial Sequence
  synthetic polynucleotide
gacagguacauauccauuc

SEQ ID NO: 3864 - RNA, 25 nt, Artificial Sequence
  synthetic polynucleotide
gccaucgacagguacauauccauua

SEQ ID NO: 3865 - RNA, 19 nt, Artificial Sequence
  synthetic polynucleotide
aucgacagguacauaucca

SEQ ID NO: 3866 - RNA, 25 nt, Artificial Sequence
  synthetic polynucleotide
acagccaucgacagguacauaucca

SEQ ID NO: 3867 - RNA, 19 nt, Artificial Sequence
  synthetic polynucleotide
ccaucgacagguacauauc

SEQ ID NO: 3868 - RNA, 25 nt, Artificial Sequence
  synthetic polynucleotide
ucacagccaucgacagguacauaua

SEQ ID NO: 3869 - RNA, 19 nt, Artificial Sequence
  synthetic polynucleotide
gccaucgacagguacauau

SEQ ID NO: 3870 - RNA, 25 nt, Artificial Sequence
  synthetic polynucleotide
cucacagccaucgacagguacauaa

SEQ ID NO: 3871 - RNA, 19 nt, Artificial Sequence
  synthetic polynucleotide
acguguuucuguucaaacu

SEQ ID NO: 3872 - RNA, 25 nt, Artificial Sequence
  synthetic polynucleotide
gccgcaacguguuucuguucaaaca

SEQ ID NO: 3873 - RNA, 19 nt, Artificial Sequence
  synthetic polynucleotide
aacguguuucuguucaaac

SEQ ID NO: 3874 - RNA, 25 nt, Artificial Sequence
  synthetic polynucleotide
agccgcaacguguuucuguucaaaa

SEQ ID NO: 3875 - RNA, 19 nt, Artificial Sequence
  synthetic polynucleotide
agaaagcugcaucaagagc

SEQ ID NO: 3876 - RNA, 25 nt, Artificial Sequence
  synthetic polynucleotide
ggccgcagaaagcugcaucaagaga

SEQ ID NO: 3877 - RNA, 19 nt, Artificial Sequence
  synthetic polynucleotide
gcagaaagcugcaucaaga

SEQ ID NO: 3878 - RNA, 25 nt, Artificial Sequence
  synthetic polynucleotide
agggccgcagaaagcugcaucaaga

SEQ ID NO: 3879 - RNA, 19 nt, Artificial Sequence
  synthetic polynucleotide
ucaugguguaugaugucuu

SEQ ID NO: 3880 - RNA, 25 nt, Artificial Sequence
  synthetic polynucleotide
uugcaaucaugguguaugaugucua

SEQ ID NO: 3881 - RNA, 19 nt, Artificial Sequence
  synthetic polynucleotide
aucaugguguaugaugucu

SEQ ID NO: 3882 - RNA, 25 nt, Artificial Sequence
  synthetic polynucleotide
cuugcaaucaugguguaugauguca

SEQ ID NO: 3883 - RNA, 19 nt, Artificial Sequence
  synthetic polynucleotide
caaucaugguguaugaugu

SEQ ID NO: 3884 - RNA, 25 nt, Artificial Sequence
  synthetic polynucleotide
ugcuugcaaucaugguguaugauga

SEQ ID NO: 3885 - RNA, 19 nt, Artificial Sequence
  synthetic polynucleotide
ugaaaccuaccugauguuc

SEQ ID NO: 3886 - RNA, 25 nt, Artificial Sequence
  synthetic polynucleotide
cauugaugaaaccuaccugauguua

SEQ ID NO: 3887 - RNA, 19 nt, Artificial Sequence
  synthetic polynucleotide
caaucuguuugcucagaca

SEQ ID NO: 3888 - RNA, 25 nt, Artificial Sequence
  synthetic polynucleotide
aaacugcaaucuguuugcucagaca

SEQ ID NO: 3889 - RNA, 19 nt, Artificial Sequence
  synthetic polynucleotide
gcaaucuguuugcucagac

SEQ ID NO: 3890 - RNA, 25 nt, Artificial Sequence
  synthetic polynucleotide
gaaacugcaaucuguuugcucagaa

SEQ ID NO: 3891 - RNA, 19 nt, Artificial Sequence
  synthetic polynucleotide
ugcaaucuguuugcucaga

SEQ ID NO: 3892 - RNA, 25 nt, Artificial Sequence
  synthetic polynucleotide
agaaacugcaaucuguuugcucaga

SEQ ID NO: 3893 - RNA, 19 nt, Artificial Sequence
  synthetic polynucleotide
cugcaaucuguuugcucag

SEQ ID NO: 3894 - RNA, 25 nt, Artificial Sequence
  synthetic polynucleotide
gagaaacugcaaucuguuugcucaa

SEQ ID NO: 3895 - RNA, 19 nt, Artificial Sequence
  synthetic polynucleotide
ugguguaugaugucuuugg

SEQ ID NO: 3896 - RNA, 25 nt, Artificial Sequence
  synthetic polynucleotide
caaucaugguguaugaugucuuuga

SEQ ID NO: 3897 - RNA, 19 nt, Artificial Sequence
  synthetic polynucleotide
augguguaugaugucuuug

SEQ ID NO: 3898 - RNA, 25 nt, Artificial Sequence
  synthetic polynucleotide
gcaaucaugguguaugaugucuuua

SEQ ID NO: 3899 - RNA, 19 nt, Artificial Sequence
  synthetic polynucleotide
auugaugaaaccuaccuga

SEQ ID NO: 3900 - RNA, 25 nt, Artificial Sequence
  synthetic polynucleotide
ccacacauugaugaaaccuaccuga

SEQ ID NO: 3901 - RNA, 19 nt, Artificial Sequence
  synthetic polynucleotide
acauugaugaaaccuaccu

SEQ ID NO: 3902 - RNA, 25 nt, Artificial Sequence
  synthetic polynucleotide
ucccacacauugaugaaaccuacca

SEQ ID NO: 3903 - RNA, 19 nt, Artificial Sequence
  synthetic polynucleotide
cacauugaugaaaccuacc

SEQ ID NO: 3904 - RNA, 25 nt, Artificial Sequence
  synthetic polynucleotide
uucccacacauugaugaaaccuaca

SEQ ID NO: 3905 - RNA, 19 nt, Artificial Sequence
  synthetic polynucleotide
acacauugaugaaaccuac

SEQ ID NO: 3906 - RNA, 25 nt, Artificial Sequence
  synthetic polynucleotide
uuucccacacauugaugaaaccuaa

SEQ ID NO: 3907 - RNA, 19 nt, Artificial Sequence
  synthetic polynucleotide
uaccugauguucuggaucg

SEQ ID NO: 3908 - RNA, 25 nt, Artificial Sequence
  synthetic polynucleotide
gaaaccuaccugauguucuggauca

SEQ ID NO: 3909 - RNA, 19 nt, Artificial Sequence
  synthetic polynucleotide
uguuccaccgcaaagauag

SEQ ID NO: 3910 - RNA, 25 nt, Artificial Sequence
  synthetic polynucleotide
uccacguguuccaccgcaaagauaa

SEQ ID NO: 3911 - RNA, 19 nt, Artificial Sequence
  synthetic polynucleotide
guguuccaccgcaaagaua

SEQ ID NO: 3912 - RNA, 25 nt, Artificial Sequence
  synthetic polynucleotide
uuccacguguuccaccgcaaagaua

SEQ ID NO: 3913 - RNA, 19 nt, Artificial Sequence
  synthetic polynucleotide
cuucaaggagaaugaggag

SEQ ID NO: 3914 - RNA, 25 nt, Artificial Sequence
  synthetic polynucleotide
cucguccuucaaggagaaugaggaa

SEQ ID NO: 3915 - RNA, 19 nt, Artificial Sequence
  synthetic polynucleotide
ccuucaaggagaaugagga

SEQ ID NO: 3916 - RNA, 25 nt, Artificial Sequence
  synthetic polynucleotide
ucucguccuucaaggagaaugagga

SEQ ID NO: 3917 - RNA, 19 nt, Artificial Sequence
  synthetic polynucleotide
uccuucaaggagaaugagg

SEQ ID NO: 3918 - RNA, 25 nt, Artificial Sequence
  synthetic polynucleotide
cucucguccuucaaggagaaugaga

SEQ ID NO: 3919 - RNA, 19 nt, Artificial Sequence
  synthetic polynucleotide
auucugcaguaugcucugc

SEQ ID NO: 3920 - RNA, 25 nt, Artificial Sequence
  synthetic polynucleotide
guuugcauucugcaguaugcucuga

SEQ ID NO: 3921 - RNA, 19 nt, Artificial Sequence
  synthetic polynucleotide
cauucugcaguaugcucug

SEQ ID NO: 3922 - RNA, 25 nt, Artificial Sequence
  synthetic polynucleotide
uguuugcauucugcaguaugcucua

SEQ ID NO: 3923 - RNA, 19 nt, Artificial Sequence
  synthetic polynucleotide
gcauucugcaguaugcucu

SEQ ID NO: 3924 - RNA, 25 nt, Artificial Sequence
  synthetic polynucleotide
guguuugcauucugcaguaugcuca

SEQ ID NO: 3925 - RNA, 19 nt, Artificial Sequence
  synthetic polynucleotide
agagcaucaucauccacac

SEQ ID NO: 3926 - RNA, 25 nt, Artificial Sequence
  synthetic polynucleotide
cccagaagagcaucaucauccacaa

SEQ ID NO: 3927 - RNA, 19 nt, Artificial Sequence
  synthetic polynucleotide
aagagcaucaucauccaca

SEQ ID NO: 3928 - RNA, 25 nt, Artificial Sequence
  synthetic polynucleotide
acccagaagagcaucaucauccaca

SEQ ID NO: 3929 - RNA, 19 nt, Artificial Sequence
  synthetic polynucleotide
cccagaagagcaucaucau

SEQ ID NO: 3930 - RNA, 25 nt, Artificial Sequence
  synthetic polynucleotide
guggcacccagaagagcaucaucaa

SEQ ID NO: 3931 - RNA, 19 nt, Artificial Sequence
  synthetic polynucleotide
acccagaagagcaucauca

SEQ ID NO: 3932 - RNA, 25 nt, Artificial Sequence
  synthetic polynucleotide
cguggcacccagaagagcaucauca

SEQ ID NO: 3933 - RNA, 19 nt, Artificial Sequence
  synthetic polynucleotide
ugaagucgauccuagaugg

SEQ ID NO: 3934 - RNA, 25 nt, Artificial Sequence
  synthetic polynucleotide
agguuaugaagucgauccuagauga

SEQ ID NO: 3935 - RNA, 19 nt, Artificial Sequence
  synthetic polynucleotide
augaagucgauccuagaug

SEQ ID NO: 3936 - RNA, 25 nt, Artificial Sequence
  synthetic polynucleotide
gagguuaugaagucgauccuagaua

SEQ ID NO: 3937 - RNA, 19 nt, Artificial Sequence
  synthetic polynucleotide
cagaagagcaucaucaucc

SEQ ID NO: 3938 - RNA, 25 nt, Artificial Sequence
  synthetic polynucleotide
ggcacccagaagagcaucaucauca

SEQ ID NO: 3939 - RNA, 19 nt, Artificial Sequence
  synthetic polynucleotide
ugaggagaacauccagugu

SEQ ID NO: 3940 - RNA, 25 nt, Artificial Sequence
  synthetic polynucleotide
ggagaaugaggagaacauccaguga

SEQ ID NO: 3941 - RNA, 19 nt, Artificial Sequence
  synthetic polynucleotide
aaugaggagaacauccagu

SEQ ID NO: 3942 - RNA, 25 nt, Artificial Sequence
  synthetic polynucleotide
aaggagaaugaggagaacauccaga

SEQ ID NO: 3943 - RNA, 19 nt, Artificial Sequence
  synthetic polynucleotide
agaaugaggagaacaucca

SEQ ID NO: 3944 - RNA, 25 nt, Artificial Sequence
  synthetic polynucleotide
ucaaggagaaugaggagaacaucca

SEQ ID NO: 3945 - RNA, 19 nt, Artificial Sequence
  synthetic polynucleotide
gagaaugaggagaacaucc

SEQ ID NO: 3946 - RNA, 25 nt, Artificial Sequence
  synthetic polynucleotide
uucaaggagaaugaggagaacauca

SEQ ID NO: 3947 - RNA, 19 nt, Artificial Sequence
  synthetic polynucleotide
ggagaaugaggagaacauc

SEQ ID NO: 3948 - RNA, 25 nt, Artificial Sequence
  synthetic polynucleotide
cuucaaggagaaugaggagaacaua

SEQ ID NO: 3949 - RNA, 19 nt, Artificial Sequence
  synthetic polynucleotide
aggagaaugaggagaacau

SEQ ID NO: 3950 - RNA, 25 nt, Artificial Sequence
  synthetic polynucleotide
ccuucaaggagaaugaggagaacaa

SEQ ID NO: 3951 - RNA, 19 nt, Artificial Sequence
  synthetic polynucleotide
aaggagaaugaggagaaca

SEQ ID NO: 3952 - RNA, 25 nt, Artificial Sequence
  synthetic polynucleotide
uccuucaaggagaaugaggagaaca

SEQ ID NO: 3953 - RNA, 19 nt, Artificial Sequence
  synthetic polynucleotide
uucaaggagaaugaggaga

SEQ ID NO: 3954 - RNA, 25 nt, Artificial Sequence
  synthetic polynucleotide
ucguccuucaaggagaaugaggaga

SEQ ID NO: 3955 - RNA, 19 nt, Artificial Sequence
  synthetic polynucleotide
caucaucauccacacgucu

SEQ ID NO: 3956 - RNA, 25 nt, Artificial Sequence
  synthetic polynucleotide
gaagagcaucaucauccacacguca

SEQ ID NO: 3957 - RNA, 19 nt, Artificial Sequence
  synthetic polynucleotide
agcaucaucauccacacgu

SEQ ID NO: 3958 - RNA, 25 nt, Artificial Sequence
  synthetic polynucleotide
cagaagagcaucaucauccacacga

SEQ ID NO: 3959 - RNA, 19 nt, Artificial Sequence
  synthetic polynucleotide
agguaaccaugucuguguc

SEQ ID NO: 3960 - RNA, 25 nt, Artificial Sequence
  synthetic polynucleotide
uugccaagguaaccaugucugugua

SEQ ID NO: 3961 - RNA, 19 nt, Artificial Sequence
  synthetic polynucleotide
aagguaaccaugucugugu

SEQ ID NO: 3962 - RNA, 25 nt, Artificial Sequence
  synthetic polynucleotide
auugccaagguaaccaugucuguga

SEQ ID NO: 3963 - RNA, 19 nt, Artificial Sequence
  synthetic polynucleotide
caagguaaccaugucugug

SEQ ID NO: 3964 - RNA, 25 nt, Artificial Sequence
  synthetic polynucleotide
gauugccaagguaaccaugucugua

SEQ ID NO: 3965 - RNA, 19 nt, Artificial Sequence
  synthetic polynucleotide
augcucugaggaguaagga

SEQ ID NO: 3966 - RNA, 25 nt, Artificial Sequence
  synthetic polynucleotide
ucaucuaugcucugaggaguaagga

SEQ ID NO: 3967 - RNA, 19 nt, Artificial Sequence
  synthetic polynucleotide
uaugcucugaggaguaagg

SEQ ID NO: 3968 - RNA, 25 nt, Artificial Sequence
  synthetic polynucleotide
aucaucuaugcucugaggaguaaga

SEQ ID NO: 3969 - RNA, 19 nt, Artificial Sequence
  synthetic polynucleotide
cuaugcucugaggaguaag

SEQ ID NO: 3970 - RNA, 25 nt, Artificial Sequence
  synthetic polynucleotide
caucaucuaugcucugaggaguaaa

SEQ ID NO: 3971 - RNA, 19 nt, Artificial Sequence
  synthetic polynucleotide
ucuaugcucugaggaguaa

SEQ ID NO: 3972 - RNA, 25 nt, Artificial Sequence
  synthetic polynucleotide
ccaucaucuaugcucugaggaguaa

SEQ ID NO: 3973 - RNA, 19 nt, Artificial Sequence
  synthetic polynucleotide
uugcaaucaugguguauga

SEQ ID NO: 3974 - RNA, 25 nt, Artificial Sequence
  synthetic polynucleotide
cucugcuugcaaucaugguguauga

SEQ ID NO: 3975 - RNA, 19 nt, Artificial Sequence
  synthetic polynucleotide
cuugcaaucaugguguaug

SEQ ID NO: 3976 - RNA, 25 nt, Artificial Sequence
  synthetic polynucleotide
ccucugcuugcaaucaugguguaua

SEQ ID NO: 3977 - RNA, 19 nt, Artificial Sequence
  synthetic polynucleotide
gcuugcaaucaugguguau

SEQ ID NO: 3978 - RNA, 25 nt, Artificial Sequence
  synthetic polynucleotide
cccucugcuugcaaucaugguguaa

SEQ ID NO: 3979 - RNA, 19 nt, Artificial Sequence
  synthetic polynucleotide
ugcuugcaaucauggugua

SEQ ID NO: 3980 - RNA, 25 nt, Artificial Sequence
  synthetic polynucleotide
gcccucugcuugcaaucauggugua

SEQ ID NO: 3981 - RNA, 19 nt, Artificial Sequence
  synthetic polynucleotide
cugcuugcaaucauggugu

SEQ ID NO: 3982 - RNA, 25 nt, Artificial Sequence
  synthetic polynucleotide
ggcccucugcuugcaaucaugguga

SEQ ID NO: 3983 - RNA, 19 nt, Artificial Sequence
  synthetic polynucleotide
ucugcuugcaaucauggug

SEQ ID NO: 3984 - RNA, 25 nt, Artificial Sequence
  synthetic polynucleotide
gggcccucugcuugcaaucauggua

SEQ ID NO: 3985 - RNA, 19 nt, Artificial Sequence
  synthetic polynucleotide
cucugcuugcaaucauggu

SEQ ID NO: 3986 - RNA, 25 nt, Artificial Sequence
  synthetic polynucleotide
ggggcccucugcuugcaaucaugga

SEQ ID NO: 3987 - RNA, 19 nt, Artificial Sequence
  synthetic polynucleotide
ccgcauggacauuagguua

SEQ ID NO: 3988 - RNA, 25 nt, Artificial Sequence
  synthetic polynucleotide
ccaagcccgcauggacauuagguua

SEQ ID NO: 3989 - RNA, 19 nt, Artificial Sequence
  synthetic polynucleotide
cuguuugcucagacauuuu

SEQ ID NO: 3990 - RNA, 25 nt, Artificial Sequence
  synthetic polynucleotide
ugcaaucuguuugcucagacauuua

SEQ ID NO: 3991 - RNA, 19 nt, Artificial Sequence
  synthetic polynucleotide
ucuguuugcucagacauuu

SEQ ID NO: 3992 - RNA, 25 nt, Artificial Sequence
  synthetic polynucleotide
cugcaaucuguuugcucagacauua

SEQ ID NO: 3993 - RNA, 19 nt, Artificial Sequence
  synthetic polynucleotide
gaaacugcaaucuguuugc

SEQ ID NO: 3994 - RNA, 25 nt, Artificial Sequence
  synthetic polynucleotide
cugcgagaaacugcaaucuguuuga

SEQ ID NO: 3995 - RNA, 19 nt, Artificial Sequence
  synthetic polynucleotide
agaaacugcaaucuguuug

SEQ ID NO: 3996 - RNA, 25 nt, Artificial Sequence
  synthetic polynucleotide
acugcgagaaacugcaaucuguuua

SEQ ID NO: 3997 - RNA, 19 nt, Artificial Sequence
  synthetic polynucleotide
cgagaaacugcaaucuguu

SEQ ID NO: 3998 - RNA, 25 nt, Artificial Sequence
  synthetic polynucleotide
gaacugcgagaaacugcaaucugua

SEQ ID NO: 3999 - RNA, 19 nt, Artificial Sequence
  synthetic polynucleotide
uagauggccuugcagauac

SEQ ID NO: 4000 - RNA, 25 nt, Artificial Sequence
  synthetic polynucleotide
cgauccuagauggccuugcagauaa

SEQ ID NO: 4001 - RNA, 19 nt, Artificial Sequence
  synthetic polynucleotide
cuagauggccuugcagaua

SEQ ID NO: 4002 - RNA, 25 nt, Artificial Sequence
  synthetic polynucleotide
ucgauccuagauggccuugcagaua

SEQ ID NO: 4003 - RNA, 19 nt, Artificial Sequence
  synthetic polynucleotide
cguguaugcguacauguau

SEQ ID NO: 4004 - RNA, 25 nt, Artificial Sequence
  synthetic polynucleotide
guucaucguguaugcguacauguaa

SEQ ID NO: 4005 - RNA, 19 nt, Artificial Sequence
  synthetic polynucleotide
ucguguaugcguacaugua

SEQ ID NO: 4006 - RNA, 25 nt, Artificial Sequence
  synthetic polynucleotide
uguucaucguguaugcguacaugua

SEQ ID NO: 4007 - RNA, 19 nt, Artificial Sequence
  synthetic polynucleotide
aucguguaugcguacaugu

SEQ ID NO: 4008 - RNA, 25 nt, Artificial Sequence
  synthetic polynucleotide
cuguucaucguguaugcguacauga

SEQ ID NO: 4009 - RNA, 19 nt, Artificial Sequence
  synthetic polynucleotide
ggacauuagguuagccaag

SEQ ID NO: 4010 - RNA, 25 nt, Artificial Sequence
  synthetic polynucleotide
ccgcauggacauuagguuagccaaa

SEQ ID NO: 4011 - RNA, 19 nt, Artificial Sequence
  synthetic polynucleotide
uggacauuagguuagccaa

SEQ ID NO: 4012 - RNA, 25 nt, Artificial Sequence
  synthetic polynucleotide
cccgcauggacauuagguuagccaa

SEQ ID NO: 4013 - RNA, 19 nt, Artificial Sequence
  synthetic polynucleotide
auggacauuagguuagcca

SEQ ID NO: 4014 - RNA, 25 nt, Artificial Sequence
  synthetic polynucleotide
gcccgcauggacauuagguuagcca

SEQ ID NO: 4015 - RNA, 19 nt, Artificial Sequence
  synthetic polynucleotide
cauggacauuagguuagcc

SEQ ID NO: 4016 - RNA, 25 nt, Artificial Sequence
  synthetic polynucleotide
agcccgcauggacauuagguuagca

SEQ ID NO: 4017 - RNA, 19 nt, Artificial Sequence
  synthetic polynucleotide
gcauggacauuagguuagc

SEQ ID NO: 4018 - RNA, 25 nt, Artificial Sequence
  synthetic polynucleotide
aagcccgcauggacauuagguuaga

SEQ ID NO: 4019 - RNA, 19 nt, Artificial Sequence
  synthetic polynucleotide
cgcauggacauuagguuag

SEQ ID NO: 4020 - RNA, 25 nt, Artificial Sequence
  synthetic polynucleotide
caagcccgcauggacauuagguuaa

SEQ ID NO: 4021 - RNA, 19 nt, Artificial Sequence
  synthetic polynucleotide
ggaagaugaacaagcucau

SEQ ID NO: 4022 - RNA, 25 nt, Artificial Sequence
  synthetic polynucleotide
ucuuugggaagaugaacaagcucaa

SEQ ID NO: 4023 - RNA, 19 nt, Artificial Sequence
  synthetic polynucleotide
uuacaacaagucucucucg

SEQ ID NO: 4024 - RNA, 25 nt, Artificial Sequence
  synthetic polynucleotide
agaauuuuacaacaagucucucuca

SEQ ID NO: 4025 - RNA, 19 nt, Artificial Sequence
  synthetic polynucleotide
uuuacaacaagucucucuc

SEQ ID NO: 4026 - RNA, 25 nt, Artificial Sequence
  synthetic polynucleotide
cagaauuuuacaacaagucucucua

SEQ ID NO: 4027 - RNA, 19 nt, Artificial Sequence
  synthetic polynucleotide
uuuuacaacaagucucucu

SEQ ID NO: 4028 - RNA, 25 nt, Artificial Sequence
  synthetic polynucleotide
acagaauuuuacaacaagucucuca

SEQ ID NO: 4029 - RNA, 19 nt, Artificial Sequence
  synthetic polynucleotide
gucccuuccaagagaagau

SEQ ID NO: 4030 - RNA, 25 nt, Artificial Sequence
  synthetic polynucleotide
ggggaagucccuuccaagagaagaa

SEQ ID NO: 4031 - RNA, 19 nt, Artificial Sequence
  synthetic polynucleotide
aagucccuuccaagagaag

SEQ ID NO: 4032 - RNA, 25 nt, Artificial Sequence
  synthetic polynucleotide
uaggggaagucccuuccaagagaaa

SEQ ID NO: 4033 - RNA, 19 nt, Artificial Sequence
  synthetic polynucleotide
gaagucccuuccaagagaa

SEQ ID NO: 4034 - RNA, 25 nt, Artificial Sequence
  synthetic polynucleotide
uuaggggaagucccuuccaagagaa

SEQ ID NO: 4035 - RNA, 19 nt, Artificial Sequence
  synthetic polynucleotide
uugccugauguggaccaua

SEQ ID NO: 4036 - RNA, 25 nt, Artificial Sequence
  synthetic polynucleotide
ggcguuuugccugauguggaccaua

SEQ ID NO: 4037 - RNA, 19 nt, Artificial Sequence
  synthetic polynucleotide
uuugccugauguggaccau

SEQ ID NO: 4038 - RNA, 25 nt, Artificial Sequence
  synthetic polynucleotide
uggcguuuugccugauguggaccaa

SEQ ID NO: 4039 - RNA, 19 nt, Artificial Sequence
  synthetic polynucleotide
uuuugccugauguggacca

SEQ ID NO: 4040 - RNA, 25 nt, Artificial Sequence
  synthetic polynucleotide
guggcguuuugccugauguggacca

SEQ ID NO: 4041 - RNA, 19 nt, Artificial Sequence
  synthetic polynucleotide
ggagaacuucauggacaua

SEQ ID NO: 4042 - RNA, 25 nt, Artificial Sequence
  synthetic polynucleotide
guguggggagaacuucauggacaua

SEQ ID NO: 4043 - RNA, 19 nt, Artificial Sequence
  synthetic polynucleotide
agccucuggauaacagcau

SEQ ID NO: 4044 - RNA, 25 nt, Artificial Sequence
  synthetic polynucleotide
cugcgcagccucuggauaacagcaa

SEQ ID NO: 4045 - RNA, 19 nt, Artificial Sequence
  synthetic polynucleotide
ucuguucaucguguaugcg

SEQ ID NO: 4046 - RNA, 25 nt, Artificial Sequence
  synthetic polynucleotide
acugcuucuguucaucguguaugca

SEQ ID NO: 4047 - RNA, 19 nt, Artificial Sequence
  synthetic polynucleotide
uucuguucaucguguaugc

SEQ ID NO: 4048 - RNA, 25 nt, Artificial Sequence
  synthetic polynucleotide
uacugcuucuguucaucguguauga

SEQ ID NO: 4049 - RNA, 19 nt, Artificial Sequence
  synthetic polynucleotide
cuucuguucaucguguaug

SEQ ID NO: 4050 - RNA, 25 nt, Artificial Sequence
  synthetic polynucleotide
guacugcuucuguucaucguguaua

SEQ ID NO: 4051 - RNA, 19 nt, Artificial Sequence
  synthetic polynucleotide
ugaacaagcucauuaagac

SEQ ID NO: 4052 - RNA, 25 nt, Artificial Sequence
  synthetic polynucleotide
ggaagaugaacaagcucauuaagaa

SEQ ID NO: 4053 - RNA, 19 nt, Artificial Sequence
  synthetic polynucleotide
augaacaagcucauuaaga

SEQ ID NO: 4054 - RNA, 25 nt, Artificial Sequence
  synthetic polynucleotide
gggaagaugaacaagcucauuaaga

SEQ ID NO: 4055 - RNA, 19 nt, Artificial Sequence
  synthetic polynucleotide
gaugaacaagcucauuaag

SEQ ID NO: 4056 - RNA, 25 nt, Artificial Sequence
  synthetic polynucleotide
ugggaagaugaacaagcucauuaaa

SEQ ID NO: 4057 - RNA, 19 nt, Artificial Sequence
  synthetic polynucleotide
agaugaacaagcucauuaa

SEQ ID NO: 4058 - RNA, 25 nt, Artificial Sequence
  synthetic polynucleotide
uugggaagaugaacaagcucauuaa

SEQ ID NO: 4059 - RNA, 19 nt, Artificial Sequence
  synthetic polynucleotide
aagaugaacaagcucauua

SEQ ID NO: 4060 - RNA, 25 nt, Artificial Sequence
  synthetic polynucleotide
uuugggaagaugaacaagcucauua

SEQ ID NO: 4061 - RNA, 19 nt, Artificial Sequence
  synthetic polynucleotide
uguucaucguguaugcgua

SEQ ID NO: 4062 - RNA, 25 nt, Artificial Sequence
  synthetic polynucleotide
ugcuucuguucaucguguaugcgua

SEQ ID NO: 4063 - RNA, 19 nt, Artificial Sequence
  synthetic polynucleotide
ugcgagaaacugcaaucug

SEQ ID NO: 4064 - RNA, 25 nt, Artificial Sequence
  synthetic polynucleotide
uggaacugcgagaaacugcaaucua

SEQ ID NO: 4065 - RNA, 19 nt, Artificial Sequence
  synthetic polynucleotide
cagcuucauugacuuccac

SEQ ID NO: 4066 - RNA, 25 nt, Artificial Sequence
  synthetic polynucleotide
ugucuacagcuucauugacuuccaa

SEQ ID NO: 4067 - RNA, 19 nt, Artificial Sequence
  synthetic polynucleotide
acagcuucauugacuucca

SEQ ID NO: 4068 - RNA, 25 nt, Artificial Sequence
  synthetic polynucleotide
uugucuacagcuucauugacuucca

SEQ ID NO: 4069 - RNA, 19 nt, Artificial Sequence
  synthetic polynucleotide
uacagcuucauugacuucc

SEQ ID NO: 4070 - RNA, 25 nt, Artificial Sequence
  synthetic polynucleotide
uuugucuacagcuucauugacuuca

SEQ ID NO: 4071 - RNA, 19 nt, Artificial Sequence
  synthetic polynucleotide
ucuacagcuucauugacuu

SEQ ID NO: 4072 - RNA, 25 nt, Artificial Sequence
  synthetic polynucleotide
uuuuugucuacagcuucauugacua

SEQ ID NO: 4073 - RNA, 19 nt, Artificial Sequence
  synthetic polynucleotide
gucuacagcuucauugacu

SEQ ID NO: 4074 - RNA, 25 nt, Artificial Sequence
  synthetic polynucleotide
auuuuugucuacagcuucauugaca

SEQ ID NO: 4075 - RNA, 19 nt, Artificial Sequence
  synthetic polynucleotide
cuucauggacauagagugu

SEQ ID NO: 4076 - RNA, 25 nt, Artificial Sequence
  synthetic polynucleotide
ggagaacuucauggacauagaguga

SEQ ID NO: 4077 - RNA, 19 nt, Artificial Sequence
  synthetic polynucleotide
acuucauggacauagagug

SEQ ID NO: 4078 - RNA, 25 nt, Artificial Sequence
  synthetic polynucleotide
gggagaacuucauggacauagagua

SEQ ID NO: 4079 - RNA, 19 nt, Artificial Sequence
  synthetic polynucleotide
aacuucauggacauagagu

SEQ ID NO: 4080 - RNA, 25 nt, Artificial Sequence
  synthetic polynucleotide
ggggagaacuucauggacauagaga

SEQ ID NO: 4081 - RNA, 19 nt, Artificial Sequence
  synthetic polynucleotide
auuuuacaacaagucucuc

SEQ ID NO: 4082 - RNA, 25 nt, Artificial Sequence
  synthetic polynucleotide
uacagaauuuuacaacaagucucua

SEQ ID NO: 4083 - RNA, 19 nt, Artificial Sequence
  synthetic polynucleotide
gaauuuuacaacaagucuc

SEQ ID NO: 4084 - RNA, 25 nt, Artificial Sequence
  synthetic polynucleotide
auuacagaauuuuacaacaagucua

SEQ ID NO: 4085 - RNA, 19 nt, Artificial Sequence
  synthetic polynucleotide
caucguguaugcguacaug

SEQ ID NO: 4086 - RNA, 25 nt, Artificial Sequence
  synthetic polynucleotide
ucuguucaucguguaugcguacaua

SEQ ID NO: 4087 - RNA, 19 nt, Artificial Sequence
  synthetic polynucleotide
ucaucguguaugcguacau

SEQ ID NO: 4088 - RNA, 25 nt, Artificial Sequence
  synthetic polynucleotide
uucuguucaucguguaugcguacaa

SEQ ID NO: 4089 - RNA, 19 nt, Artificial Sequence
  synthetic polynucleotide
uucaucguguaugcguaca

SEQ ID NO: 4090 - RNA, 25 nt, Artificial Sequence
  synthetic polynucleotide
cuucuguucaucguguaugcguaca

SEQ ID NO: 4091 - RNA, 19 nt, Artificial Sequence
  synthetic polynucleotide
guucaucguguaugcguac

SEQ ID NO: 4092 - RNA, 25 nt, Artificial Sequence
  synthetic polynucleotide
gcuucuguucaucguguaugcguaa

SEQ ID NO: 4093 - RNA, 19 nt, Artificial Sequence
  synthetic polynucleotide
cuguucaucguguaugcgu

SEQ ID NO: 4094 - RNA, 25 nt, Artificial Sequence
  synthetic polynucleotide
cugcuucuguucaucguguaugcga

SEQ ID NO: 4095 - RNA, 19 nt, Artificial Sequence
  synthetic polynucleotide
gaacuucauggacauagag

SEQ ID NO: 4096 - RNA, 25 nt, Artificial Sequence
  synthetic polynucleotide
uggggagaacuucauggacauagaa

SEQ ID NO: 4097 - RNA, 19 nt, Artificial Sequence
  synthetic polynucleotide
agaacuucauggacauaga

SEQ ID NO: 4098 - RNA, 25 nt, Artificial Sequence
  synthetic polynucleotide
guggggagaacuucauggacauaga

SEQ ID NO: 4099 - RNA, 19 nt, Artificial Sequence
  synthetic polynucleotide
gagaacuucauggacauag

SEQ ID NO: 4100 - RNA, 25 nt, Artificial Sequence
  synthetic polynucleotide
uguggggagaacuucauggacauaa

SEQ ID NO: 4101 - RNA, 19 nt, Artificial Sequence
  synthetic polynucleotide
acauuagguuagccaagac

SEQ ID NO: 4102 - RNA, 25 nt, Artificial Sequence
  synthetic polynucleotide
gcauggacauuagguuagccaagaa

SEQ ID NO: 4103 - RNA, 19 nt, Artificial Sequence
  synthetic polynucleotide
gacauuagguuagccaaga

SEQ ID NO: 4104 - RNA, 25 nt, Artificial Sequence
  synthetic polynucleotide
cgcauggacauuagguuagccaaga

SEQ ID NO: 4105 - RNA, 19 nt, Artificial Sequence
  synthetic polynucleotide
auguggaccauagccauug

SEQ ID NO: 4106 - RNA, 25 nt, Artificial Sequence
  synthetic polynucleotide
ugccugauguggaccauagccauua

SEQ ID NO: 4107 - RNA, 19 nt, Artificial Sequence
  synthetic polynucleotide
cagaauuuuacaacaaguc

SEQ ID NO: 4108 - RNA, 25 nt, Artificial Sequence
  synthetic polynucleotide
acauuacagaauuuuacaacaagua

SEQ ID NO: 4109 - RNA, 19 nt, Artificial Sequence
  synthetic polynucleotide
caggugaacauuacagaau

SEQ ID NO: 4110 - RNA, 25 nt, Artificial Sequence
  synthetic polynucleotide
gcagaccaggugaacauuacagaaa

SEQ ID NO: 4111 - RNA, 19 nt, Artificial Sequence
  synthetic polynucleotide
cauuuuugucuacagcuuc

SEQ ID NO: 4112 - RNA, 25 nt, Artificial Sequence
  synthetic polynucleotide
gagugucauuuuugucuacagcuua

SEQ ID NO: 4113 - RNA, 19 nt, Artificial Sequence
  synthetic polynucleotide
ucauuuuugucuacagcuu

SEQ ID NO: 4114 - RNA, 25 nt, Artificial Sequence
  synthetic polynucleotide
ggagugucauuuuugucuacagcua

SEQ ID NO: 4115 - RNA, 19 nt, Artificial Sequence
  synthetic polynucleotide
gucauuuuugucuacagcu

SEQ ID NO: 4116 - RNA, 25 nt, Artificial Sequence
  synthetic polynucleotide
gggagugucauuuuugucuacagca

SEQ ID NO: 4117 - RNA, 19 nt, Artificial Sequence
  synthetic polynucleotide
gugucauuuuugucuacag

SEQ ID NO: 4118 - RNA, 25 nt, Artificial Sequence
  synthetic polynucleotide
uggggagugucauuuuugucuacaa

SEQ ID NO: 4119 - RNA, 19 nt, Artificial Sequence
  synthetic polynucleotide
agugucauuuuugucuaca

SEQ ID NO: 4120 - RNA, 25 nt, Artificial Sequence
  synthetic polynucleotide
cuggggagugucauuuuugucuaca

SEQ ID NO: 4121 - RNA, 19 nt, Artificial Sequence
  synthetic polynucleotide
cguccuucaaggagaauga

SEQ ID NO: 4122 - RNA, 25 nt, Artificial Sequence
  synthetic polynucleotide
cucucucguccuucaaggagaauga

SEQ ID NO: 4123 - RNA, 19 nt, Artificial Sequence
  synthetic polynucleotide
ucguccuucaaggagaaug

SEQ ID NO: 4124 - RNA, 25 nt, Artificial Sequence
  synthetic polynucleotide
ucucucucguccuucaaggagaaua

SEQ ID NO: 4125 - RNA, 19 nt, Artificial Sequence
  synthetic polynucleotide
uuugcauucugcaguaugc

SEQ ID NO: 4126 - RNA, 25 nt, Artificial Sequence
  synthetic polynucleotide
acgguguuugcauucugcaguauga

SEQ ID NO: 4127 - RNA, 19 nt, Artificial Sequence
  synthetic polynucleotide
guuugcauucugcaguaug

SEQ ID NO: 4128 - RNA, 25 nt, Artificial Sequence
  synthetic polynucleotide
gacgguguuugcauucugcaguaua

SEQ ID NO: 4129 - RNA, 19 nt, Artificial Sequence
  synthetic polynucleotide
ugcauucugcaguaugcuc

SEQ ID NO: 4130 - RNA, 25 nt, Artificial Sequence
  synthetic polynucleotide
gguguuugcauucugcaguaugcua

SEQ ID NO: 4131 - RNA, 19 nt, Artificial Sequence
  synthetic polynucleotide
uugcauucugcaguaugcu

SEQ ID NO: 4132 - RNA, 25 nt, Artificial Sequence
  synthetic polynucleotide
cgguguuugcauucugcaguaugca

SEQ ID NO: 4133 - RNA, 19 nt, Artificial Sequence
  synthetic polynucleotide
uguuugcauucugcaguau

SEQ ID NO: 4134 - RNA, 25 nt, Artificial Sequence
  synthetic polynucleotide
agacgguguuugcauucugcaguaa

SEQ ID NO: 4135 - RNA, 19 nt, Artificial Sequence
  synthetic polynucleotide
ugccaagguaaccaugucu

SEQ ID NO: 4136 - RNA, 25 nt, Artificial Sequence
  synthetic polynucleotide
caagauugccaagguaaccauguca

SEQ ID NO: 4137 - RNA, 19 nt, Artificial Sequence
  synthetic polynucleotide
uugccaagguaaccauguc

SEQ ID NO: 4138 - RNA, 25 nt, Artificial Sequence
  synthetic polynucleotide
ucaagauugccaagguaaccaugua

SEQ ID NO: 4139 - RNA, 19 nt, Artificial Sequence
  synthetic polynucleotide
auugccaagguaaccaugu

SEQ ID NO: 4140 - RNA, 25 nt, Artificial Sequence
  synthetic polynucleotide
gucaagauugccaagguaaccauga

SEQ ID NO: 4141 - RNA, 19 nt, Artificial Sequence
  synthetic polynucleotide
cugcacaaacacgcaaaca

SEQ ID NO: 4142 - RNA, 25 nt, Artificial Sequence
  synthetic polynucleotide
gacugccugcacaaacacgcaaaca

SEQ ID NO: 4143 - RNA, 19 nt, Artificial Sequence
  synthetic polynucleotide
uuucccacacauugaugaa

SEQ ID NO: 4144 - RNA, 25 nt, Artificial Sequence
  synthetic polynucleotide
agacauuuucccacacauugaugaa

SEQ ID NO: 4145 - RNA, 19 nt, Artificial Sequence
  synthetic polynucleotide
uuuucccacacauugauga

SEQ ID NO: 4146 - RNA, 25 nt, Artificial Sequence
  synthetic polynucleotide
cagacauuuucccacacauugauga

SEQ ID NO: 4147 - RNA, 19 nt, Artificial Sequence
  synthetic polynucleotide
auuuucccacacauugaug

SEQ ID NO: 4148 - RNA, 25 nt, Artificial Sequence
  synthetic polynucleotide
ucagacauuuucccacacauugaua

SEQ ID NO: 4149 - RNA, 19 nt, Artificial Sequence
  synthetic polynucleotide
gcacaaacacgcaaacaau

SEQ ID NO: 4150 - RNA, 25 nt, Artificial Sequence
  synthetic polynucleotide
cugccugcacaaacacgcaaacaaa

SEQ ID NO: 4151 - RNA, 19 nt, Artificial Sequence
  synthetic polynucleotide
ugcacaaacacgcaaacaa

SEQ ID NO: 4152 - RNA, 25 nt, Artificial Sequence
  synthetic polynucleotide
acugccugcacaaacacgcaaacaa

SEQ ID NO: 4153 - RNA, 19 nt, Artificial Sequence
  synthetic polynucleotide
caagauugccaagguaacc

SEQ ID NO: 4154 - RNA, 25 nt, Artificial Sequence
  synthetic polynucleotide
cacggucaagauugccaagguaaca

SEQ ID NO: 4155 - RNA, 19 nt, Artificial Sequence
  synthetic polynucleotide
ucaagauugccaagguaac

SEQ ID NO: 4156 - RNA, 25 nt, Artificial Sequence
  synthetic polynucleotide
gcacggucaagauugccaagguaaa

SEQ ID NO: 4157 - RNA, 19 nt, Artificial Sequence
  synthetic polynucleotide
gucaagauugccaagguaa

SEQ ID NO: 4158 - RNA, 25 nt, Artificial Sequence
  synthetic polynucleotide
agcacggucaagauugccaagguaa

SEQ ID NO: 4159 - RNA, 19 nt, Artificial Sequence
  synthetic polynucleotide
uguuucaugguccugaacc

SEQ ID NO: 4160 - RNA, 25 nt, Artificial Sequence
  synthetic polynucleotide
auagaguguuucaugguccugaaca

SEQ ID NO: 4161 - RNA, 19 nt, Artificial Sequence
  synthetic polynucleotide
cacacauugaugaaaccua

SEQ ID NO: 4162 - RNA, 25 nt, Artificial Sequence
  synthetic polynucleotide
uuuucccacacauugaugaaaccua

SEQ ID NO: 4163 - RNA, 19 nt, Artificial Sequence
  synthetic polynucleotide
ccacacauugaugaaaccu

SEQ ID NO: 4164 - RNA, 25 nt, Artificial Sequence
  synthetic polynucleotide
auuuucccacacauugaugaaacca

SEQ ID NO: 4165 - RNA, 19 nt, Artificial Sequence
  synthetic polynucleotide
cccacacauugaugaaacc

SEQ ID NO: 4166 - RNA, 25 nt, Artificial Sequence
  synthetic polynucleotide
cauuuucccacacauugaugaaaca

SEQ ID NO: 4167 - RNA, 19 nt, Artificial Sequence
  synthetic polynucleotide
ucccacacauugaugaaac

SEQ ID NO: 4168 - RNA, 25 nt, Artificial Sequence
  synthetic polynucleotide
acauuuucccacacauugaugaaaa

SEQ ID NO: 4169 - RNA, 19 nt, Artificial Sequence
  synthetic polynucleotide
uucccacacauugaugaaa

SEQ ID NO: 4170 - RNA, 25 nt, Artificial Sequence
  synthetic polynucleotide
gacauuuucccacacauugaugaaa

SEQ ID NO: 4171 - RNA, 19 nt, Artificial Sequence
  synthetic polynucleotide
auuuuugucuacagcuuca

SEQ ID NO: 4172 - RNA, 25 nt, Artificial Sequence
  synthetic polynucleotide
agugucauuuuugucuacagcuuca

SEQ ID NO: 4173 - RNA, 19 nt, Artificial Sequence
  synthetic polynucleotide
caagagcacggucaagauu

SEQ ID NO: 4174 - RNA, 25 nt, Artificial Sequence
  synthetic polynucleotide
cugcaucaagagcacggucaagaua

SEQ ID NO: 4175 - RNA, 19 nt, Artificial Sequence
  synthetic polynucleotide
aucaagagcacggucaaga

SEQ ID NO: 4176 - RNA, 25 nt, Artificial Sequence
  synthetic polynucleotide
agcugcaucaagagcacggucaaga

SEQ ID NO: 4177 - RNA, 19 nt, Artificial Sequence
  synthetic polynucleotide
gcuucuguucaucguguau

SEQ ID NO: 4178 - RNA, 25 nt, Artificial Sequence
  synthetic polynucleotide
cguacugcuucuguucaucguguaa

SEQ ID NO: 4179 - RNA, 19 nt, Artificial Sequence
  synthetic polynucleotide
ugcuucuguucaucgugua

SEQ ID NO: 4180 - RNA, 25 nt, Artificial Sequence
  synthetic polynucleotide
gcguacugcuucuguucaucgugua

SEQ ID NO: 4181 - RNA, 19 nt, Artificial Sequence
  synthetic polynucleotide
ggucaagauugccaaggua

SEQ ID NO: 4182 - RNA, 25 nt, Artificial Sequence
  synthetic polynucleotide
gagcacggucaagauugccaaggua

SEQ ID NO: 4183 - RNA, 19 nt, Artificial Sequence
  synthetic polynucleotide
ugucuacagcuucauugac

SEQ ID NO: 4184 - RNA, 25 nt, Artificial Sequence
  synthetic polynucleotide
cauuuuugucuacagcuucauugaa

SEQ ID NO: 4185 - RNA, 19 nt, Artificial Sequence
  synthetic polynucleotide
uugucuacagcuucauuga

SEQ ID NO: 4186 - RNA, 25 nt, Artificial Sequence
  synthetic polynucleotide
ucauuuuugucuacagcuucauuga

SEQ ID NO: 4187 - RNA, 19 nt, Artificial Sequence
  synthetic polynucleotide
uuugucuacagcuucauug

SEQ ID NO: 4188 - RNA, 25 nt, Artificial Sequence
  synthetic polynucleotide
gucauuuuugucuacagcuucauua

SEQ ID NO: 4189 - RNA, 19 nt, Artificial Sequence
  synthetic polynucleotide
uuuugucuacagcuucauu

SEQ ID NO: 4190 - RNA, 25 nt, Artificial Sequence
  synthetic polynucleotide
ugucauuuuugucuacagcuucaua

SEQ ID NO: 4191 - RNA, 19 nt, Artificial Sequence
  synthetic polynucleotide
uuucccucuugugaaggca

SEQ ID NO: 4192 - RNA, 25 nt, Artificial Sequence
  synthetic polynucleotide
agcauguuucccucuugugaaggca

SEQ ID NO: 4193 - RNA, 19 nt, Artificial Sequence
  synthetic polynucleotide
aagagcacggucaagauug

SEQ ID NO: 4194 - RNA, 25 nt, Artificial Sequence
  synthetic polynucleotide
ugcaucaagagcacggucaagauua

SEQ ID NO: 4195 - RNA, 19 nt, Artificial Sequence
  synthetic polynucleotide
uggaccauagccauuguga

SEQ ID NO: 4196 - RNA, 25 nt, Artificial Sequence
  synthetic polynucleotide
cugauguggaccauagccauuguga

SEQ ID NO: 4197 - RNA, 19 nt, Artificial Sequence
  synthetic polynucleotide
ccaggugaacauuacagaa

SEQ ID NO: 4198 - RNA, 25 nt, Artificial Sequence
  synthetic polynucleotide
agcagaccaggugaacauuacagaa

SEQ ID NO: 4199 - RNA, 19 nt, Artificial Sequence
  synthetic polynucleotide
ucaucauccacacgucuga

SEQ ID NO: 4200 - RNA, 25 nt, Artificial Sequence
  synthetic polynucleotide
agagcaucaucauccacacgucuga

SEQ ID NO: 4201 - RNA, 19 nt, Artificial Sequence
  synthetic polynucleotide
aucaucauccacacgucug

SEQ ID NO: 4202 - RNA, 25 nt, Artificial Sequence
  synthetic polynucleotide
aagagcaucaucauccacacgucua

SEQ ID NO: 4203 - RNA, 20 nt, Artificial Sequence
  synthetic polynucleotide
uuagaaaggugcaaacaagg

SEQ ID NO: 4204 - RNA, 20 nt, Artificial Sequence
  synthetic polynucleotide
uuagaaaggugcaaacaagg

SEQ ID NO: 4205 - RNA, 19 nt, Artificial Sequence
  synthetic polynucleotide
ucaacuagaaaggugcaaa

SEQ ID NO: 4206 - RNA, 19 nt, Artificial Sequence
  synthetic polynucleotide
ugucuuccagucgguaagc

SEQ ID NO: 4207 - RNA, 19 nt, Artificial Sequence
  synthetic polynucleotide
gaacaggcgcuccacucug

SEQ ID NO: 4208 - RNA, 19 nt, Artificial Sequence
  synthetic polynucleotide
caguuguaauggcaggcac

SEQ ID NO: 4209 - RNA, 19 nt, Artificial Sequence
  synthetic polynucleotide
agccagaaagcucaaacuu

SEQ ID NO: 4210 - RNA, 19 nt, Artificial Sequence
  synthetic polynucleotide
caggcgcuccacucugugg

SEQ ID NO: 4211 - RNA, 19 nt, Artificial Sequence
  synthetic polynucleotide
aacaggcgcuccacucugu

SEQ ID NO: 4212 - RNA, 19 nt, Artificial Sequence
  synthetic polynucleotide
agaaagcucaaacuugaua

SEQ ID NO: 4213 - RNA, 19 nt, Artificial Sequence
  synthetic polynucleotide
aguuguaauggcaggcaca

SEQ ID NO: 4214 - RNA, 19 nt, Artificial Sequence
  synthetic polynucleotide
cgugucuuccagucgguaa

SEQ ID NO: 4215 - RNA, 19 nt, Artificial Sequence
  synthetic polynucleotide
ggaccaggcaguuggcucu

SEQ ID NO: 4216 - RNA, 19 nt, Artificial Sequence
  synthetic polynucleotide
caggcacaggucuugauga

SEQ ID NO: 4217 - RNA, 19 nt, Artificial Sequence
  synthetic polynucleotide
gcgcuccacucuguggucu

SEQ ID NO: 4218 - RNA, 19 nt, Artificial Sequence
  synthetic polynucleotide
ggucuggaccaggcaguug

SEQ ID NO: 4219 - RNA, 19 nt, Artificial Sequence
  synthetic polynucleotide
acaguuguaauggcaggca

SEQ ID NO: 4220 - RNA, 19 nt, Artificial Sequence
  synthetic polynucleotide
guuguaauggcaggcacag

SEQ ID NO: 4221 - RNA, 19 nt, Artificial Sequence
  synthetic polynucleotide
ggacaguuguaauggcagg

SEQ ID NO: 4222 - RNA, 19 nt, Artificial Sequence
  synthetic polynucleotide
gacaguuguaauggcaggc

SEQ ID NO: 4223 - RNA, 19 nt, Artificial Sequence
  synthetic polynucleotide
ggcgcuccacucugugguc

SEQ ID NO: 4224 - RNA, 19 nt, Artificial Sequence
  synthetic polynucleotide
ucuuccagucgguaagccg

SEQ ID NO: 4225 - RNA, 19 nt, Artificial Sequence
  synthetic polynucleotide
ugucuccguacaucuuccu

SEQ ID NO: 4226 - RNA, 19 nt, Artificial Sequence
  synthetic polynucleotide
agcuucgcaaggccugacc

SEQ ID NO: 4227 - RNA, 19 nt, Artificial Sequence
  synthetic polynucleotide
cacuccucgcagcauuucc

SEQ ID NO: 4228 - RNA, 19 nt, Artificial Sequence
  synthetic polynucleotide
aaacuugauaggcuuggag

SEQ ID NO: 4229 - RNA, 19 nt, Artificial Sequence
  synthetic polynucleotide
acuccacagaauuuagcuc

SEQ ID NO: 4230 - RNA, 19 nt, Artificial Sequence
  synthetic polynucleotide
augucuccguacaucuucc

SEQ ID NO: 4231 - RNA, 19 nt, Artificial Sequence
  synthetic polynucleotide
aacuugauaggcuuggaga

SEQ ID NO: 4232 - RNA, 19 nt, Artificial Sequence
  synthetic polynucleotide
aagcucaaacuugauaggc

SEQ ID NO: 4233 - RNA, 19 nt, Artificial Sequence
  synthetic polynucleotide
acauacuccacagaauuua

SEQ ID NO: 4234 - RNA, 19 nt, Artificial Sequence
  synthetic polynucleotide
cuccacagaauuuagcucg

SEQ ID NO: 4235 - RNA, 19 nt, Artificial Sequence
  synthetic polynucleotide
ugugcuacugaaaucauuu

SEQ ID NO: 4236 - RNA, 19 nt, Artificial Sequence
  synthetic polynucleotide
aaagaugucauugucuccg

SEQ ID NO: 4237 - RNA, 19 nt, Artificial Sequence
  synthetic polynucleotide
gugcacugguacuugcagc

SEQ ID NO: 4238 - RNA, 19 nt, Artificial Sequence
  synthetic polynucleotide
aaacgugucuuccagucgg

SEQ ID NO: 4239 - RNA, 19 nt, Artificial Sequence
  synthetic polynucleotide
ucaaacuugauaggcuugg

SEQ ID NO: 4240 - RNA, 19 nt, Artificial Sequence
  synthetic polynucleotide
acagaauuuagcucgguau

SEQ ID NO: 4241 - RNA, 19 nt, Artificial Sequence
  synthetic polynucleotide
uuacauucuaccuauggug

SEQ ID NO: 4242 - RNA, 19 nt, Artificial Sequence
  synthetic polynucleotide
aaacugaucagcuauauag

SEQ ID NO: 4243 - RNA, 19 nt, Artificial Sequence
  synthetic polynucleotide
uaucugagcagaauuucca

SEQ ID NO: 4244 - RNA, 19 nt, Artificial Sequence
  synthetic polynucleotide
uuaacuuagauaacuguac

SEQ ID NO: 4245 - RNA, 19 nt, Artificial Sequence
  synthetic polynucleotide
uauuacucguauaagaugc

SEQ ID NO: 4246 - RNA, 19 nt, Artificial Sequence
  synthetic polynucleotide
aagcuguccagucuaaucg

SEQ ID NO: 4247 - RNA, 19 nt, Artificial Sequence
  synthetic polynucleotide
uaauaaaggccauuuguuc

SEQ ID NO: 4248 - RNA, 19 nt, Artificial Sequence
  synthetic polynucleotide
uuuagcucgguaugucuuc

SEQ ID NO: 4249 - RNA, 19 nt, Artificial Sequence
  synthetic polynucleotide
acacucucaacaaauaaac

SEQ ID NO: 4250 - RNA, 19 nt, Artificial Sequence
  synthetic polynucleotide
uagcucgguaugucuucau

SEQ ID NO: 4251 - RNA, 19 nt, Artificial Sequence
  synthetic polynucleotide
uaaccuuucugcugguacc

SEQ ID NO: 4252 - RNA, 19 nt, Artificial Sequence
  synthetic polynucleotide
uuaaggaacaacuugacuc

SEQ ID NO: 4253 - RNA, 19 nt, Artificial Sequence
  synthetic polynucleotide
uuacacuucaaauagcagg

SEQ ID NO: 4254 - RNA, 19 nt, Artificial Sequence
  synthetic polynucleotide
uccaggucagcuucgcaag

SEQ ID NO: 4255 - RNA, 19 nt, Artificial Sequence
  synthetic polynucleotide
cuucuucaugaccucgccg

SEQ ID NO: 4256 - RNA, 19 nt, Artificial Sequence
  synthetic polynucleotide
aaggccugaccaugcacag

SEQ ID NO: 4257 - RNA, 19 nt, Artificial Sequence
  synthetic polynucleotide
caaacgugucuuccagucg

SEQ ID NO: 4258 - RNA, 19 nt, Artificial Sequence
  synthetic polynucleotide
cuucgcaaggccugaccau

SEQ ID NO: 4259 - RNA, 19 nt, Artificial Sequence
  synthetic polynucleotide
cuuccagucgguaagccgc

SEQ ID NO: 4260 - RNA, 19 nt, Artificial Sequence
  synthetic polynucleotide
ccgaucuugcgguuggccg

SEQ ID NO: 4261 - RNA, 19 nt, Artificial Sequence
  synthetic polynucleotide
uucgcaaggccugaccaug

SEQ ID NO: 4262 - RNA, 19 nt, Artificial Sequence
  synthetic polynucleotide
agaauuuagcucgguaugu

SEQ ID NO: 4263 - RNA, 19 nt, Artificial Sequence
  synthetic polynucleotide
cauacuccacagaauuuag

SEQ ID NO: 4264 - RNA, 19 nt, Artificial Sequence
  synthetic polynucleotide
ugccaugucuccguacauc

SEQ ID NO: 4265 - RNA, 19 nt, Artificial Sequence
  synthetic polynucleotide
gaggcguugucauugguaa

SEQ ID NO: 4266 - RNA, 19 nt, Artificial Sequence
  synthetic polynucleotide
ucuucaugaccucgccguc

SEQ ID NO: 4267 - RNA, 19 nt, Artificial Sequence
  synthetic polynucleotide
uccacagaauuuagcucgg

SEQ ID NO: 4268 - RNA, 19 nt, Artificial Sequence
  synthetic polynucleotide
aacgugucuuccagucggu

SEQ ID NO: 4269 - RNA, 19 nt, Artificial Sequence
  synthetic polynucleotide
cuccguacaucuuccugua

SEQ ID NO: 4270 - RNA, 19 nt, Artificial Sequence
  synthetic polynucleotide
aggcguugucauugguaac

SEQ ID NO: 4271 - RNA, 19 nt, Artificial Sequence
  synthetic polynucleotide
ucaugaccucgccgucagg

SEQ ID NO: 4272 - RNA, 19 nt, Artificial Sequence
  synthetic polynucleotide
ggccaaacgugucuuccag

SEQ ID NO: 4273 - RNA, 19 nt, Artificial Sequence
  synthetic polynucleotide
gccaugucuccguacaucu

SEQ ID NO: 4274 - RNA, 19 nt, Artificial Sequence
  synthetic polynucleotide
ucgcaaggccugaccaugc

SEQ ID NO: 4275 - RNA, 19 nt, Artificial Sequence
  synthetic polynucleotide
aggucagcuucgcaaggcc

SEQ ID NO: 4276 - RNA, 19 nt, Artificial Sequence
  synthetic polynucleotide
ccguacaucuuccuguagu

SEQ ID NO: 4277 - RNA, 19 nt, Artificial Sequence
  synthetic polynucleotide
gagccgaagucacagaaga

SEQ ID NO: 4278 - RNA, 19 nt, Artificial Sequence
  synthetic polynucleotide
ggagccgaagucacagaag

SEQ ID NO: 4279 - RNA, 19 nt, Artificial Sequence
  synthetic polynucleotide
caaggccugaccaugcaca

SEQ ID NO: 4280 - RNA, 19 nt, Artificial Sequence
  synthetic polynucleotide
agcucaaacuugauaggcu

SEQ ID NO: 4281 - RNA, 19 nt, Artificial Sequence
  synthetic polynucleotide
cugcaguucuggccgacgg

SEQ ID NO: 4282 - RNA, 19 nt, Artificial Sequence
  synthetic polynucleotide
gguacauacuccacagaau

SEQ ID NO: 4283 - RNA, 19 nt, Artificial Sequence
  synthetic polynucleotide
cugcuucucuagccugcag

SEQ ID NO: 4284 - RNA, 19 nt, Artificial Sequence
  synthetic polynucleotide
gcaaggccugaccaugcac

SEQ ID NO: 4285 - RNA, 19 nt, Artificial Sequence
  synthetic polynucleotide
cagaauuuagcucgguaug

SEQ ID NO: 4286 - RNA, 19 nt, Artificial Sequence
  synthetic polynucleotide
ccaaacgugucuuccaguc

SEQ ID NO: 4287 - RNA, 19 nt, Artificial Sequence
  synthetic polynucleotide
cuucaugaccucgccguca

SEQ ID NO: 4288 - RNA, 19 nt, Artificial Sequence
  synthetic polynucleotide
gcuucgcaaggccugacca

SEQ ID NO: 4289 - RNA, 19 nt, Artificial Sequence
  synthetic polynucleotide
ucagcuucgcaaggccuga

SEQ ID NO: 4290 - RNA, 19 nt, Artificial Sequence
  synthetic polynucleotide
gucuuccagucgguaagcc

SEQ ID NO: 4291 - RNA, 19 nt, Artificial Sequence
  synthetic polynucleotide
caaacuugauaggcuugga

SEQ ID NO: 4292 - RNA, 19 nt, Artificial Sequence
  synthetic polynucleotide
aggucuuggaacaggcgcu

SEQ ID NO: 4293 - RNA, 19 nt, Artificial Sequence
  synthetic polynucleotide
caggucagcuucgcaaggc

SEQ ID NO: 4294 - RNA, 19 nt, Artificial Sequence
  synthetic polynucleotide
gucagcuucgcaaggccug

SEQ ID NO: 4295 - RNA, 19 nt, Artificial Sequence
  synthetic polynucleotide
ggcguugucauugguaacc

SEQ ID NO: 4296 - RNA, 19 nt, Artificial Sequence
  synthetic polynucleotide
cgugcacugguacuugcag

SEQ ID NO: 4297 - RNA, 19 nt, Artificial Sequence
  synthetic polynucleotide
gucuuggaacaggcgcucc

SEQ ID NO: 4298 - RNA, 19 nt, Artificial Sequence
  synthetic polynucleotide
ccaugucuccguacaucuu

SEQ ID NO: 4299 - RNA, 19 nt, Artificial Sequence
  synthetic polynucleotide
ggucagcuucgcaaggccu

SEQ ID NO: 4300 - RNA, 19 nt, Artificial Sequence
  synthetic polynucleotide
cagcuucgcaaggccugac

SEQ ID NO: 4301 - RNA, 19 nt, Artificial Sequence
  synthetic polynucleotide
gccgaagucacagaagagg

SEQ ID NO: 4302 - RNA, 19 nt, Artificial Sequence
  synthetic polynucleotide
cacagaauuuagcucggua

SEQ ID NO: 4303 - RNA, 19 nt, Artificial Sequence
  synthetic polynucleotide
ccacagaauuuagcucggu

SEQ ID NO: 4304 - RNA, 19 nt, Artificial Sequence
  synthetic polynucleotide
gccaaacgugucuuccagu

SEQ ID NO: 4305 - RNA, 19 nt, Artificial Sequence
  synthetic polynucleotide
gccgaucuugcgguuggcc

SEQ ID NO: 4306 - RNA, 19 nt, Artificial Sequence
  synthetic polynucleotide
cucaaacuugauaggcuug

SEQ ID NO: 4307 - RNA, 19 nt, Artificial Sequence
  synthetic polynucleotide
ccaggucagcuucgcaagg

SEQ ID NO: 4308 - RNA, 19 nt, Artificial Sequence
  synthetic polynucleotide
uaugaguuaaugucucuca

SEQ ID NO: 4309 - RNA, 13 nt, Artificial Sequence
  synthetic polynucleotide
gaucacauuugaa

SEQ ID NO: 4310 - RNA, 19 nt, Artificial Sequence
  synthetic polynucleotide
uucaaaugugaucuggaug

SEQ ID NO: 4311 - RNA, 13 nt, Artificial Sequence
  synthetic polynucleotide
gaucacauuugaa

SEQ ID NO: 4312 - RNA, 19 nt, Artificial Sequence
  synthetic polynucleotide
uucaaaugugaucuggaug

SEQ ID NO: 4313 - RNA, 13 nt, Artificial Sequence
  synthetic polynucleotide
gaucacauuugaa

SEQ ID NO: 4314 - RNA, 19 nt, Artificial Sequence
  synthetic polynucleotide
uucaaaugugaucuggaug

SEQ ID NO: 4315 - RNA, 14 nt, Artificial Sequence
  synthetic polynucleotide
gaucacauuugaua

SEQ ID NO: 4316 - RNA, 20 nt, Artificial Sequence
  synthetic polynucleotide
uaucaaaugugaucuggaug

SEQ ID NO: 4317 - RNA, 14 nt, Artificial Sequence
  synthetic polynucleotide
gaucacauuugaua

SEQ ID NO: 4318 - RNA, 20 nt, Artificial Sequence
  synthetic polynucleotide
uaucaaaugugaucuggaug

SEQ ID NO: 4319 - RNA, 14 nt, Artificial Sequence
  synthetic polynucleotide
gaucacauuugaua

What is claimed is:

1. A double-stranded ribonucleic acid (dsRNA) directed against CTGF comprising a sense strand and an antisense strand wherein the sense strand comprises at least 12 contiguous nucleotides of a sequence selected from the group consisting of SEQ ID NOs: 2463 (GCACCUUUCUAGA), 3429 (G.mC. A.mC.mC.mU.mU.mU.mC.mU. A*mG*mA.TEG-Chl), 2443 (UUGCACCUUUCUAA), 3445 (mU.mU.G.mC.A.mC.mC.mU.mU.mU.mC.mU*mA* mA.TEG-Chl), 2465 (CCUUUCUAGUUGA), and 3469 (mC.mC.mU.mU.mU.mC.mU. A. G.mU.mU*mG*mA.TEG-Chl) and/or wherein the antisense strand comprises at least 12 contiguous nucleotides of a sequence selected from the group consisting of SEQ ID NOs: 2464 (UCUAGAAAGGUGCAAACAU), 3430 (P.mU.fC.fU. A. G.mA. A.mA. G. G.fU. G.mC* A* A* A*mC* A* U), 4203 (UUAGAAAGGUGCAAACAAGG), 3446 (P.mU.fU. A. G. A.mA. A. G. G.fU. G.fC.mA.mA*mA*fC*mA*mA*mG* G.), 2466 (UCAACUAGAAAGGUGCAAA), and 3470 (P.mU.fC. A. A.fC.fU. A. G. A.mA. A. G. G*fU*mG*fC*mA*mA* A.), wherein the dsRNA is an sd-rxRNA,
wherein the antisense strand is 16-23 nucleotides long and the sense strand is 8-15 nucleotides long, wherein the sd-rxRNA includes a double stranded region and a single stranded region, wherein the double stranded region is from 8-15 nucleotides long, wherein the single stranded region is at the 3' end of the antisense strand and is 4-12 nucleotides long, wherein the single stranded region contains 3, 4, 5, 6, 7, 8, 9, 10, 11 or 12 phosphorothioate modifications, and wherein at least 40% of the nucleotides of the isolated double stranded nucleic acid molecule are modified.

2. The dsRNA of claim 1, wherein the sense strand comprises SEQ ID NO:2463 (GCACCUUUCUAGA) and the antisense strand comprises SEQ ID NO:2464 (UCUAGAAAGGUGCAAACAU).

3. The dsRNA of claim 1, wherein the sense strand comprises SEQ ID NO:3429 (G.mC. A.mC.mC.mU.mU.mU.mC.mU. A*mG*mA.TEG-Chl) and the antisense strand comprises SEQ ID NO:3430 (P.mU.fC.fU. A. G.mA. A.mA. G. G.fU. G.mC* A* A* A*mC* A* U).

4. The dsRNA of claim 1, wherein the sense strand comprises SEQ ID NO:2443 (UUGCACCUUUCUAA) and the antisense strand comprises SEQ ID NO:4203 (UUAGAAAGGUGCAAACAAGG), the sense strand comprises SEQ ID NO:3445 (mU.mU. G.mC. A.mC.mC.mU.mU.mU.mC.mU*mA*mA.TEG-Chl) and the antisense strand comprises SEQ ID NO:3446 (P.mU.fU. A. G. A.mA. A. G. G.fU. G.fC.mA.mA*mA*fC*mA*mA*mG* G.), the sense strand comprises SEQ ID NO:2465 (CCUUUCUAGUUGA) and the antisense strand comprises SEQ ID NO:2466 (UCAACUAGAAAGGUGCAAA) or the sense strand comprises SEQ ID NO:3469 (mC.mC.mU.mU.mU.mC.mU. A. G.mU.mU*mG*mA.TEG-Chl) and the antisense strand comprises SEQ ID NO:3470 (P.mU.fC. A. A.fC.fU. A. G. A.mA. A. G. G*fU*mG*fC*mA*mA* A.).

5. The dsRNA of claim 1, wherein the dsRNA is hydrophobically modified and/or wherein the dsRNA is linked to a hydrophobic conjugate.

6. A composition comprising the dsRNA of claim 1, optionally wherein the composition comprises dsRNA directed against genes encoding for more than one protein.

7. The composition of claim 1 wherein the composition is formulated for delivery to the skin, for topical delivery, for intradermal injection and/or wherein the composition is in a neutral formulation.

8. A method comprising delivering the dsRNA of claim 1 to the skin of a subject in need thereof.

9. A method comprising,
administering to a subject in need thereof a therapeutically effective amount of a double stranded ribonucleic acid (dsRNA) directed against CTGF comprising a sense strand and an antisense strand wherein the sense strand comprises at least 12 contiguous nucleotides of a sequence selected from the group consisting of SEQ ID NOs: 2463 (GCACCUUUCUAGA), 3429 (G.mC. A.mC.mC.mU.mU.mU.mC.mU. A*mG*mA.TEG-Chl), 2443 (UUGCACCUUUCUAA), 3445 (mU.mU. G.mC. A.mC.mC.mU.mU.mU.mC.mU*mA*mA.TEG-Chl), 2465 (CCUUUCUAGUUGA), and 3469 (mC.mC.mU-.mU.mU.mC.mU. A. G.mU.mU*mG*mA.TEG-Chl) and/or wherein the antisense strand comprises at least 12 contiguous nucleotides of a sequence selected from the group consisting of SEQ ID NOs: 2464 (UCUA-GAAAGGUGCAAACAU), 3430 (P.mU.fC.fU. A. G.mA. A.mA. G. G.fU. G.mC* A* A* A*mC* A* U), 4203 (UUAGAAAGGUGCAAACAAGG), 3446 (P.mU.fU. A. G. A.mA. A. G. G.fU. G.fC.mA.mA*mA*fC*mA*mA*mG* G.), 2466 (UCAACUAGAAAGGUGCAAA), and 3470 (P.mU.fC. A. A.fC.fU. A. G. A.mA. A. G. G*fU*mG*fC*mA*mA* A.), wherein the dsRNA is an sd-rxRNA,
wherein the antisense strand is 16-23 nucleotides long and the sense strand is 8-15 nucleotides long, wherein the sd-rxRNA includes a double stranded region and a single stranded region, wherein the double stranded region is from 8-15 nucleotides long, wherein the single stranded region is at the 3' end of the antisense strand and is 4-12 nucleotides long, wherein the single stranded region contains 3, 4, 5, 6, 7, 8, 9, 10, 11 or 12 phosphorothioate modifications, and wherein at least 40% of the nucleotides of the isolated double stranded nucleic acid molecule are modified.

10. The method of claim 9, wherein the dsRNA is administered via intradermal injection or is administered locally to the skin.

11. The method of claim 9, wherein the dsRNA is hydrophobically modified and/or is linked to a hydrophobic conjugate.

12. A double-stranded ribonucleic acid (dsRNA) directed against CTGF comprising a sense strand and an antisense strand wherein the sense strand comprises at least 12 contiguous nucleotides of SEQ ID NOs: 2459 (GUGACCAAAAGUA) or 3493 (G.mU. G. A.mC.mC. A. A. A. A. G*mU*mA.TEG-Chl) and/or wherein the antisense strand comprises at least 12 contiguous nucleotides of SEQ ID NOs: 2460 (UACUUUUGGUCACACUCUC) or 3494 (P.mU. A.fC.fU.fU.fU.fU. G. G.fU.mC. A.mC* A*mC*mU*mC*mU* C.), wherein the dsRNA is an sd-rxRNA,
wherein the antisense strand is 16-23 nucleotides long and the sense strand is 8-15 nucleotides long, wherein the sd-rxRNA includes a double stranded region and a single stranded region, wherein the double stranded region is from 8-15 nucleotides long, wherein the single stranded region is at the 3' end of the antisense strand and is 4-12 nucleotides long, wherein the single stranded region contains 3, 4, 5, 6, 7, 8, 9, 10, 11 or 12 phosphorothioate modifications, and wherein at least 40% of the nucleotides of the isolated double stranded nucleic acid molecule are modified.

13. The dsRNA of claim 12, wherein the sense strand comprises SEQ ID NO:2459 (GUGACCAAAAGUA) and the antisense strand comprises SEQ ID NO:2460 (UACUUUUGGUCACACUCUC), or the sense strand comprises SEQ ID NO:3493 (G.mU. G. A.mC.mC. A. A. A. A. G*mU*mA.TEG-Chl) and the antisense strand comprises SEQ ID NO:3494 (P.mU. A.fC.fU.fU.fU.fU. G. G.fU.mC. A.mC* A*mC*mU*mC*mU* C.).

14. The dsRNA of claim 12, wherein the dsRNA is hydrophobically modified and/or wherein the dsRNA is linked to a hydrophobic conjugate.

15. A composition comprising the dsRNA of claim 12, optionally wherein the composition comprises dsRNA directed against genes encoding for more than one protein.

16. The composition of claim 15 wherein the composition is formulated for delivery to the skin, for topical delivery, for intradermal injection and/or wherein the composition is in a neutral formulation.

17. A method comprising delivering the dsRNA of claim 12 to the skin of a subject in need thereof.

18. A method comprising,
administering to a subject in need thereof a therapeutically effective amount of a double stranded ribonucleic acid (dsRNA) directed against CTGF comprising a sense strand and an antisense strand wherein the sense strand comprises at least 12 contiguous nucleotides of SEQ ID NOs: 2459 (GUGACCAAAAGUA) or 3493 (G.mU. G. A.mC.mC. A. A. A. A. G*mU*mA.TEG-Chl) and/or wherein the antisense strand comprises at least 12 contiguous nucleotides of SEQ ID NOs: 2460 (UACUUUUGGUCACACUCUC) or 3494 (P.mU. A.fC.fU.fU.fU.fU. G. G.fU.mC. A.mC* A*mC*mU*mC*mU* C.), wherein the dsRNA is an sd-rxRNA,
wherein the antisense strand is 16-23 nucleotides long and the sense strand is 8-15 nucleotides long, wherein the sd-rxRNA includes a double stranded region and a single stranded region, wherein the double stranded region is from 8-15 nucleotides long, wherein the single stranded region is at the 3' end of the antisense strand and is 4-12 nucleotides long, wherein the single stranded region contains 3, 4, 5, 6, 7, 8, 9, 10, 11 or 12 phosphorothioate modifications, and wherein at least 40% of the nucleotides of the isolated double stranded nucleic acid molecule are modified.

19. The method of claim 18, wherein the dsRNA is administered via intradermal injection or is administered locally to the skin.

20. The method of claim 18, wherein the dsRNA is hydrophobically modified and/or is linked to a hydrophobic conjugate.

* * * * *